United States Patent 11,624,072 (CANOLA WITH HIGH OLEIC ACID) - sequence listing, part 4

SEQ ID NO: 19251 - DNA, 357 bp, Artificial
  Mutation in BnaC.FAD2.a introduced by TALE nuclease pair BnFAD2_T02
cctctcctccctcaccctctcccttacctcgcctggcccctctactgggcctgacaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgaagctaaccgtccagttcacgctcggctggcctttgtacttag

SEQ ID NO: 19252 - DNA, 352 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19253 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaaatccgacatcaagtggtacggaaaggacctcaacaacccgctaggacgcacggtgatgctaaccgtccagttcacgctcgcctggcctttgtacttag

SEQ ID NO: 19254 - DNA, 310 bp, Artificial
  Mutation in BnaC.FAD2.a introduced by TALE nuclease pair BnFAD2_T02
cctctcctacctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19255 - DNA, 357 bp, Artificial
  Mutation in BnaC.FAD2.a introduced by TALE nuclease pair BnFAD2_T02
cctctcctccctcaccctctctcctacttcgcctggcctttctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19256 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaactgtttgtccccaagaagaaatccgacatcaagtggtacggaaagtacctcaacaacccgctaggacgcacggtgatgctaaccgtccagttcacgctcggctggcctttgtacttag

SEQ ID NO: 19257 - DNA, 332 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19258 - DNA, 332 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggcttcctcgagagagacgaagtgtttgtccccaagaagaagtcagacatcaagtggtacggcaagtacctcaacaaccctttgggacgcgccgggatgttaacggttcagttcactctcggctgccctttgtacttag

SEQ ID NO: 19259 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19260 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19261 - DNA, 358 bp, Artificial
  Mutation in BnaC.FAD2.a introduced by TALE nuclease pair BnFAD2_T02
cctctcctccctcaccctctcccttacctcgcctggcccctctaatgggcctgccaaggctgcgtcctaacgggcctctgggtcatagcccacgagtgcggccaccacgccttcagcgactaccagtggcttgacgacaccgtcggtgtcatcttccactccttcctcctcgtcccttacttctcctggaacagtcatcgacgccaccattccaacactggctccctcgagagagacgaagtgtttttccccaagaagaaggcagacatcaagtggtacggcaagtacctcaacaaccctttgggacgcaccgtgatgttaatggtgcagttcactcgcggctggcctttgtacttag

SEQ ID NO: 19262 - DNA, 355 bp, Artificial
  Mutation in BnaC.FAD2.a introduced by TALE nuclease pair BnFAD2_T02
cctctcctccctcaccctctctcctacttcgtctggcctctctactgggcctgccaagggtgcgtcctaaccggcgtctgggtcatagcccacgagtgcggccaccacgccttcagcgactaccagtggcttgacgacaccgtcggtctcatcttccactccttcctcatcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19263 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccttctcgtccattacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19264 - DNA, 336 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19265 - DNA, 350 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 19266 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19267 - DNA, 354 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaaatccgacatcaagtggtacggcaagtacctcaacaaccctttgggacgcaccgtgatgctaaccgtccagttcacgctcggctggcctttgtacttag

SEQ ID NO: 19268 - DNA, 433 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcggcgagcggtatcagctcactcaaaggcggtaatacggttatccacagaatcaagggataacgcaggaaagaacagtcatcgacgccaccattccaacactggctccctcgagagagacgaagtgtttgtccccaagaagaagtcagacatcaagtggtacggcaagtacctcaacgaccctttgggacgcaccgtgatgttaacggttcagttcactctcggctggcctttgtacttag

SEQ ID NO: 19269 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19270 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19271 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagccatcgacgccaccattccaacaccggatccctcgagagggatgaagtgttcgtccccaagaagaagtccgacatcaagtggtacggaaagtacctcaacaacccgctaggacgcacggtgatgctaaccgtccagttcacgctcggctggcctttgtacttag

SEQ ID NO: 19272 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactctcggctggcctttgtacttag

SEQ ID NO: 19273 - DNA, 291 bp, Artificial
  Mutation in BnaC.FAD2.a introduced by TALE nuclease pair BnFAD2_T02
cctctcctccctcaccctctctcctacttcgcctgtcctctctactgggcctgccaagggtgcgtcctaaccggcgtctgggtcatagcccaccagtgcggccaccacgccatcagcgactaccagtggcttgacgacaccgtcggaagactggctccctcgagagagacgaactgtttgtccccaagaagaagtcagacatcaagtggtacggcaagtacctcaacaaccctttgggacgcaccgtgatggtaactgatacattcactctaggctgcccgtgttacgtaa

SEQ ID NO: 19274 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtacggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttttacttag

SEQ ID NO: 19275 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19276 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaccgggcctctgggtcatcgcccacgaatgcggccaccacgccttcagcaactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaaggcagccatcaagtggtacgggaagtacctctacaaccctttgggacgcaccgtgatgttaacgtttcatttcactctcgggtgcccgttgtacttag

SEQ ID NO: 19277 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaatatcgacgccaccattccaacactggctccctcgagagagacgaagtgtttgtccccaagaagaagtcagacatcaagtggtacggcaagtacctcaacaaccctttgggacgcgccgtgatgttaacggttcagttctctctcggctggccgttgtacttag

SEQ ID NO: 19278 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtgtcatcgacgccaccattccaacaccggctccctcgagagagacgaagtgttcgtccccaagaagaagtcagacatcaagtggtacggcaagtacctcaacaaccctctgggacgcacggtgatgttaacggttcagttcacgctcggctggcctttgtacttag

SEQ ID NO: 19279 - DNA, 355 bp, Artificial
  Mutation in BnaC.FAD2.a introduced by TALE nuclease pair BnFAD2_T02
ccttcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 19280 - DNA, 358 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19281 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttcatcgacgccaccattccaacactggctccctcgagagagacgaagtgtttgtccccaagaagaagtcacacatcaagtggtacggcaagtacctcaacaacccgctaggacgcgcggtgatgctaaccgtccagttcacgctcggctggcctttgtacttat

SEQ ID NO: 19282 - DNA, 366 bp, Artificial
  Mutation in BnaC.FAD2.a introduced by TALE nuclease pair BnFAD2_T02
cctctcctccctcaccctctcccctacttcgcctggcctctctactgggcctgccaagggtgcgtcctaaccggcgtctgggtcatagcccacgagtgcggccaccacgccttcagcgacgaccagtggcttgacgacaccgtcggtctcatcttccactccttcctcctcgtcccttacttctcctggaagtacaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 19283 - DNA, 367 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19284 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19285 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagttcctcaacaaccctttgggacgcaccgtgatgttaacggttcagttcactctcggctggcctttgtacttag

SEQ ID NO: 19286 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgtgtcatagcccacgagtgcggccaccacgccttcagcgactaccagtggcttgacgacaccgtcggtctcatcttccactcctttctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19287 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttggcgacaccgtcggtctcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19288 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 19289 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 19290 - DNA, 357 bp, Artificial
  Mutation in BnaC.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgaccaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19291 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19292 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19293 - DNA, 332 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19294 - DNA, 359 bp, Artificial
  Mutation in BnaC.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19295 - DNA, 406 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccggaagtactccagcgcctgcttgccaccattattgctggcgatggccaccacctgtcatcgacgccaccattccgacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19296 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccgtttgggacgcaccgtgatgttaacggttcggttcactctcggctggcctttgtacttag

SEQ ID NO: 19297 - DNA, 357 bp, Artificial
  Mutation in BnaC.FAD2.a introduced by TALE nuclease pair BnFAD2_T02
cctctcctccctcaccctctctcctacttcgtctggcctctttactgtgattgccaagggtgcgtcctaaccggcggctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtaccccaccacccctttgggacgcaacatgctgttaacgctccagttccctctcggctggcctttgtacttag

SEQ ID NO: 19298 - DNA, 354 bp, Artificial
  Mutation in BnaC.FAD2.a introduced by TALE nuclease pair BnFAD2_T02
cctctcctccctcaccctctcccttacctcgcctggcacctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 19299 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctgggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttaa

SEQ ID NO: 19300 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactcctttctcctcgtcccttactcctcctcatcgacgccaccattccaacactggctccctcgagagagacgaagtttttgtccccaagaagaagtcagacatcaagtggtacggcaagtacctcaacaaccctttgggacgcaccgtgatgttaacggttcagttcactctcggctggcctttgtacttag

SEQ ID NO: 19301 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggcgggcctttgtacttag

SEQ ID NO: 19302 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19303 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccatcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19304 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctaagcaaccgtttgggacgcaccgtgatgttaaccgtccagttcacgctcggctggcctttgtacttag

SEQ ID NO: 19305 - DNA, 355 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19306 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19307 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19308 - DNA, 363 bp, Artificial
  Mutation in BnaC.FAD2.a introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacatccgtttgggacgcaccgtgatgttaacggttcagttcactctcggctggcctttgtacttag

SEQ ID NO: 19309 - DNA, 453 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagcgcaacggctgttgccggtgctgtgccaggcccacggcttgaccccccagcaggtggtggccatcgccagcaatggcggtggcaagcaggcgctggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19310 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19311 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccactagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacagccctttgggacgcgccgtgatgttaacggttcagttcgctctcggctggcctttgtacttag

SEQ ID NO: 19312 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19313 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacacccctttgggacgcgccgtgatgttaacggttcagttcactctcggctggcctttgtacttag

SEQ ID NO: 19314 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttatagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcactctcggctggcctttgtacttag

SEQ ID NO: 19315 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19316 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacacagtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19317 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 19318 - DNA, 356 bp, Artificial
  Mutation in BnaC.FAD2.a introduced by TALE nuclease pair BnFAD2_T02
cctctcctccctcaccctctctcctacttcgcctggcctctctcctgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagttcctcaacaacccttcgggacgcaccgtgatgttaacggtacagttcactctcggctggcctttgtacttag

SEQ ID NO: 19319 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgacttccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19320 - DNA, 355 bp, Artificial
  Mutation in BnaC.FAD2.a introduced by TALE nuclease pair BnFAD2_T02
cctctcctccctcaccctctctcctacttcgcgtggcctctctactcggcctgccaaggctgcgccccaaccggcgcctgggtcatagcccacgagtgcggccaccacgccttcagcgactaccagtggcttgacgacaccgtcggtctcctcttccactccttcctcctcgtcccttacttctcctggaatcatcgacgccaccattccaacactggctccctcgagagagacgaagtgtttgtccccaagaagaagtcagacatcaagtggtacggcaagtagctcaacacgcctgtgggacgcacggtgatgttaacggttcagttccctctcggctggcctttgtacttag

SEQ ID NO: 19321 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaggcgctaaatgaaaccttaacgctatggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19322 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 19323 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 19324 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19325 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19326 - DNA, 446 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtatgttgccgctggaccagcggtggtttgtttgccggatcaagagctaccaactctttttccgaaggtaactggcttcagcagagcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19327 - DNA, 358 bp, Artificial
  Mutation in BnaC.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19328 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgccctaaccggcttctgggccatagcccacgagtgcggccaccacgccttcagcgactaccagtggcttgacgacaccgtcggtctcatcttccactccttcctcctcgtcccttacttctcctggaagtttcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19329 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagatatcaagtggtacggcaagtacctcaacaaccctttgggacgcaccgtgatgttaacggttcagttcactctcggctggcctttgtacttag

SEQ ID NO: 19330 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtactag

SEQ ID NO: 19331 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19332 - DNA, 354 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19333 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19334 - DNA, 362 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19335 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19336 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttggttgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19337 - DNA, 310 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19338 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggccgcgtcctaacgggcctctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 19339 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19340 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagcggcttgacgacaccgtcggtctcatcttccactccttcctcctcgtcccttacttctcctggaagtgtcatcgacgccaccatttcaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19341 - DNA, 360 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacatcaagtggtacggcaagttcctcaacaaccctttgggacgcaccgtgagtttaacggttcagttcactctcggctggcctttgtacttag

SEQ ID NO: 19342 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19343 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgaggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaagccgccatcaagtggtacgcaaagtacctcaacaacccgctaggtcgcacggtgatgctaaccgtgaagttcacgcgcggctggcctttgtacttag

SEQ ID NO: 19344 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggcgcgccctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtaccccaacgaccccgtgggacgcaccagaatgttaacagtgcagttcactcccggctggcctttgtacgtag

SEQ ID NO: 19345 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19346 - DNA, 356 bp, Artificial
  Mutation in BnaC.FAD2.a introduced by TALE nuclease pair BnFAD2_T02
cctctcctccctcaccctctctcctacttcgcctggcctctctcctgggcctcccaagggtgcgtcctaaccggcgtctgggtcatagcccacgagtgcggccaccacgccttcagcgactaccagtggcttgacgacaccgtcggtctcaccttccactccttcctcctcctcccttacttctcctggaagtcatcgacgccaccattccaacactggccccctcgagagagacgaagtgtttgtccccaagaagaagtcagacatcaactggtacggcaggtacctcagcaaccctttggaacgcaccgtgatgttaacggtacaggtcactctcggctggcctttgtacttag

SEQ ID NO: 19347 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcatcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19348 - DNA, 335 bp, Artificial
  Mutation in BnaC.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19349 - DNA, 354 bp, Artificial
  Mutation in BnaC.FAD2.a introduced by TALE nuclease pair BnFAD2_T02
cctctcctccctcaccctctcccttacctcgcctggcctctctactgtgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19350 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggccatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19351 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19352 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19353 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtccggcatgtacctcaacagcccttggggacgcaccatgatgttaacggtccagttcactctcggctggcctttgtacttag

SEQ ID NO: 19354 - DNA, 354 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19355 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcgtcttccactccttcctcctcgtcccttacttctcctggaaggtcatcgacgccaccattccaacactggctccctcgagagagacgatgtgtttgtccccaagaagaagtcagacatcaagtggtacggcaagtacctcaacaaccctttgggacgcaccgtgatgttaacggttcagttcactctcggctggcctttgtacttag

SEQ ID NO: 19356 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19357 - DNA, 378 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatatggcggcaagcaggcgctggagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19358 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 19359 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 19360 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaacacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 19361 - DNA, 342 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggcatgtacctcaacaacccgcgaggacgcaaggtggtgctaaccctccagttcacgctcggctggcctttgtacttag

SEQ ID NO: 19362 - DNA, 443 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaggcgatggccaccacctgctccggggtcaagccgtgggcctggcacagcaccggcaacagcgcctgcaccgtctccagcgcctagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19363 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactgactccctcgagagagacgaagtgtttgtccccaagaagaagtcagacatcaagtggtacggcaagtacctcaacaaccctttgggacgcaccgtgatgttaaccgtccagttcacgctcggctggccttttacttag

SEQ ID NO: 19364 - DNA, 389 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggccatagcccacgagtgcggccaccacgccttcagcgactaccagtggcttgacgacaccgtcggtctcatcttccactccttcctcctcgtcccttacttctcctggaagtctggcgccgtcgggcttcatggagccgcccagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19365 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19366 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaacccgctaggacgcacggtgatgctaaccgtccagttaacgctcggctggcctttgtacttag

SEQ ID NO: 19367 - DNA, 348 bp, Artificial
  Mutation in BnaC.FAD2.a introduced by TALE nuclease pair BnFAD2_T02
cctctcctccctcaccctctcttctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19368 - DNA, 393 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagactgagcctttcgttttatctgttgtttgtcggtgaacgctcgccagcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19369 - DNA, 312 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgacttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19370 - DNA, 312 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19371 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19372 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtaccgcaacaacccttttggacgcaccgtgatgttaacggttcagttcacgctcggctggcctttgtacttag

SEQ ID NO: 19373 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19374 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctttcttctcctggaacatcgacgccaccattccaacactggctccctcgagagagacgaagtgtttgtccccaagaagaagtcagccatcaagtggtacggcaagtacctcaacacccctttgggacgcaccgtgatgttcacggttcagttcactctcggctcgcatttgtacttag

SEQ ID NO: 19375 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaaccgtcgagttcactctcggctggtatttgtacttag

SEQ ID NO: 19376 - DNA, 357 bp, Artificial
  Mutation in BnaC.FAD2.a introduced by TALE nuclease pair BnFAD2_T02
cctctcctccctcaccctctctcctacttcgcctggcctctctactgtgcttgccaagggtgcgtcctcaccggcgtctgggtcatagcccacgagcgccgccaccacgccttcagtgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagccacacatcaagtggtacggcaagtacctcaacaccccagagggacgcaagaggatgttaacccttcagttcactctcggctggcctttgtacttag

SEQ ID NO: 19377 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtatgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 19378 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggcctttgtacttag

SEQ ID NO: 19379 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19380 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19381 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19382 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacaccaagtggtacggcaagtacctcaacaaccctgtgggacgcaccgtgatgttaacggttcagttcactctcggctggcctttgtacttag

SEQ ID NO: 19383 - DNA, 342 bp, Artificial
  Mutation in BnaC.FAD2.a introduced by TALE nuclease pair BnFAD2_T02
cctctccttcctcatcctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19384 - DNA, 354 bp, Artificial
  Mutation in BnaC.FAD2.a introduced by TALE nuclease pair BnFAD2_T02
cctctcatccctcaccctctctcctacttcgcctggcctctctactgggcctgccaagggtgcgtcctaaccggcgtctgggtcatagcccacgagtgcggccaccacgccttcagcgactacaagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19385 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacaccggatccctcgagagtgatgaagtgttcgtccccaagaagaaatccgacatcaagtggtacggaaagtacctcaacaaccctttgggacgcaccgtgatgttaacggtgcagttcactctcggctggcctttgtacttag

SEQ ID NO: 19386 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19387 - DNA, 470 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagcgcctcaaatagatcctgttcaggaaccggatcaaagagttcctccgccgctggacctaccaaggcaacgctatgttctcttgcttttgtcagcaagatagccagatcaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19388 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaggtcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 19389 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 19390 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacacccctgtgggacgcaccgtgatgttaacggtgcagttcactctcggctggcatttgtacttag

SEQ ID NO: 19391 - DNA, 319 bp, Artificial
  Mutation in BnaC.FAD2.a introduced by TALE nuclease pair BnFAD2_T02
cctctcctcccccaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19392 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaagagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 19393 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactcccggctggcctttgtacgtag

SEQ ID NO: 19394 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19395 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtcttggtcatagcccacgagtgcggccaccacgccttcagcgactaccagtggctggacgacgccgtgggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctgtgggacgcaccgtgaggttaacggttcagttcactctcggctggcctttgtacttag

SEQ ID NO: 19396 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19397 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19398 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaaatggtacggcaagtacctcaacaaccctttgggacgcaccgtgatgttaacggttcagttcactctcggctggcctttgtacttag

SEQ ID NO: 19399 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgtggaggtcactctcggctggaagttgtacttag

SEQ ID NO: 19400 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19401 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 19402 - DNA, 456 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtacaaacaacgcggcgagctttgatcaacgaccttttggaaacttcggcttccccttaacgcaggaaagaacatgtgagcaaaaggccagcaaaaggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19403 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccatttgggacgcaccgtgatgttaacggttcagttcacgctcggctggcctttgtacttag

SEQ ID NO: 19404 - DNA, 443 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgcaatgcactgacgggtgccccgctcaacttgacccctctccagcgcctgcttgccgccatcgtggctggcgatggccaccaccagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19405 - DNA, 331 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 19406 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 19407 - DNA, 403 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatctccagcgcctgcttgccaccgccattgctggcgatggccaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 19408 - DNA, 354 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19409 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctgtgggacgcaccgtgatgttaacggtgcagttcactctcggctggcctttgtacttag

SEQ ID NO: 19410 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 19411 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgatgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19412 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgtttgtccccaagaagaagtcagacatcaagtggtccggcaagtacctcaacaacccgctaggacgcacggtgatgctaaccgtcaagttcacgctcggctggcctttgtacttag

SEQ ID NO: 19413 - DNA, 356 bp, Artificial
  Mutation in BnaC.FAD2.a introduced by TALE nuclease pair BnFAD2_T02
cctctcctccctcaccctctctcctacttcgtctggcttctctactctgactcccaagtctgcgtcctaaccggcgtctgggtcatagcccacgagtgcgtccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtcgtccgtcaagtaccccgacgcgtctgttgtgcgcaacatacagttaaccgttccgttccctctcggctggcctttgtacttag

SEQ ID NO: 19414 - DNA, 355 bp, Artificial
  Mutation in BnaC.FAD2.a introduced by TALE nuclease pair BnFAD2_T02
ctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19415 - DNA, 357 bp, Artificial
  Mutation in BnaC.FAD2.a introduced by TALE nuclease pair BnFAD2_T02
cctctcctccctcaccctctctcctgcttcgcctggcctctctactgtgcctcccaagggtgcgtcctcaccggcgtctgggtcatcgcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtccggcaagtaccccaacaacccgctaggacgtacggggctgttaaccgttccgttccctctcggctggcctttgtacttag

SEQ ID NO: 19416 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19417 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19418 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggcgcgccctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaaatccgacatcaagtggtacggcaagtacctcaacaaccctgtgggacgcaccgtgatgttaaccgttcagttcactctcggctggcctttgtacttag

SEQ ID NO: 19419 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactacctgtggcttgacgacaccgtcgatctcatcttccactccttcctcctcgtcccttacagtcatcgacgccaccattccaacactggctccctcgagagagacgaagtgtttgtccccaagaagaaatcagacatcaagtggtacggcaagtacctcaacaaccctttgggacgcaccgtgatgttaacggttcagttcactctcggctggccgttgtacttag

SEQ ID NO: 19420 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctagtacgcacggtgatgctaaccgtccagttcacgctcggctggcctttgtacttag

SEQ ID NO: 19421 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacatgccttcgggacgcaccgtgatgttaaccgttcagttcacgctcggctggcctttgtacttag

SEQ ID NO: 19422 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaaatccgacatcaagtggtacggaaagtacctcaacaacccgctaggacgcacggtgaagctaaccgtccagttcacgctcggctggcctttgtacttag

SEQ ID NO: 19423 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19424 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttcgtacttag

SEQ ID NO: 19425 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcttagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19426 - DNA, 393 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagactgagcctttcgttttatctgttgtttgtcggtgaacgctcgccagcaaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19427 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtcccaaagaagaaatccgacatcaagtggtacggaaagtacctcaacaacccgctaggacgcacggtgatgctaaccgtccagttcacgctcggctggcctttgtacttag

SEQ ID NO: 19428 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19429 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 19430 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19431 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 19432 - DNA, 396 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcaatttgttgcaacgaacaggtcactatcagtcaaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 19433 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcgagtggtacggcaagtacctcaacatccctttgggacgcaccgtggtgttaacggttcagttcactctcggctggcctttgtacttag

SEQ ID NO: 19434 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19435 - DNA, 318 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19436 - DNA, 405 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctggatcatagcccacgagtgcggccaccacgccttcagcgactaccagtggcttgacgacaccgtcggtctcatcttccactccttcctcctcgtcccttacttctcctggaagtacagcgcctgcttgccaccgccattgctggcgatggccaccacctgtgtcatcgacaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19437 - DNA, 341 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctactcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19438 - DNA, 358 bp, Artificial
  Mutation in BnaC.FAD2.a introduced by TALE nuclease pair BnFAD2_T02
gctctcctccctcaccctctctcctacttcgcctggcctctctactgggccggccaagggtgcgtcctaaccggcgtctgggtcatagcccacgagtgcggccaccacgccttcagcgactacaagtggcttgacgacaccgtcggtctcatcttccactccttcctcctcgtcccttacttctcctggaagagtcatcgacgccaccattccaacactctctccctcgatagagacgaagtgtttgtccccaagaagaagtcacacatcaagtggtacggcaagtacctcaactgccctttgggacgcgccttgatgttaacggttcagttcactctcggctggcctttgtacttag

SEQ ID NO: 19439 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctttacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19440 - DNA, 413 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggcacagcaccggcaacagcgcctgcaccgtctccagcgcctgcttgccaccaatatcatcgacgccaccattccaacattggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19441 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 19442 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcttcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19443 - DNA, 291 bp, Artificial
  Mutation in BnaC.FAD2.a introduced by TALE nuclease pair BnFAD2_T02
cctctcctccctcaccctctctcctacttcgcctggcctccctaccgggcccgccaagggagcgccctaaccggcgtctgggtcatagcccacgagtgcggccaccacgccttcagcgactaccagtggcttgacgccaccgtcggaagactggctccctcgagagagacgaagtgtttgtccccaagaacaagtcacacatcaagtggttcggcatgtacctcatcagctctttgggacgcaccgtgatgttaaccgttccgttcactctcggctggcctttgtacttag

SEQ ID NO: 19444 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19445 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctaatcttccactccttcctcctcgtcccttacttctcctggacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19446 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 19447 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagggatgaagtgttcgtccccaagaagaaaaccgacatcaagtggtacggaaagtacctcaacaacccgctaggacgcacggtgatgctaaccttccagttcacgctcggctggcctttgtacttag

SEQ ID NO: 19448 - DNA, 345 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 19449 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaataagaagtcagacatcaagtggtacggcaagtacctcaacaaccctttgggacgcaccgtgatgttaacggttgagttcactctcggctggcctttgtacttag

SEQ ID NO: 19450 - DNA, 389 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatggtggccatcgccagcaatggcggtgacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19451 - DNA, 392 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtgcattgcgcttaccagaggaaaactagaaactcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19452 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcctccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19453 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtatgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19454 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19455 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgccctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 19456 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 19457 - DNA, 365 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgttccttacttctcctggaccgtctccagcgcctgcttgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19458 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacaccgtcggtctcatcttccactccttcctcctcgtcccttacttctcctggaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19459 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 19460 - DNA, 348 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19461 - DNA, 318 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagtccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19462 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagccgaagtgtttgtccccaagacgaagtcagacagcaagtggtacggcaactacctcagcagccctttgggacgcgccgtggtgttaacggttcagttcgctctccgctcccctatctcctac

SEQ ID NO: 19463 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 19464 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagcagtcacacatcaagtggtacggcaagtacctcaacaaccctttgggccgccccgtgatgttaaccgttcagttcactctcggctggcctttgtgcctac

SEQ ID NO: 19465 - DNA, 427 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctccagcgcctgcttgccaccattattgctggcgatggccaccacctgctggggggtcaagccgtgggcctggcacagcaccggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19466 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttatccatgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19467 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaaatccgacatcaagtggtacggaaagtacctcaacaacccgctaggacgcacggtgatgctaatcgtgcagttcacgctcggctggcctttgcacttag

SEQ ID NO: 19468 - DNA, 341 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19469 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaatccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19470 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 19471 - DNA, 446 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtatgttgccgctggaccagcggtggtttgtttgccggatcaagagctaccaactctttttccgaaggtaactggcttcagcagagcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19472 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccatacttctccaggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19473 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacatccgtttgggacgcaccgtgatgttaacggttcagttcactctcggctggcctttgtacttag

SEQ ID NO: 19474 - DNA, 336 bp, Artificial
  Mutation in BnaC.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcatcgacgccaccattccaacactggatccctcgagagagacgaagtgttcgtccccaagaagaaatccgacatcaagtggtacggcaagtacctcaacaaccctttgggacgcaccgtgatgttaacggttcagttcactctcggctggcctttgtacttat

SEQ ID NO: 19475 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19476 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19477 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19478 - DNA, 358 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19479 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19480 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacaccggatccctcgagagggatgaagtgttcgtccccaagaagaaatccgacatcaagtggtacggaaagtacctcaacaacccgctaggacgcacggtgatgctaaccgtgcagttcacgctcggctggcctttgtacttag

SEQ ID NO: 19481 - DNA, 308 bp, Artificial
  Mutation in BnaC.FAD2.a introduced by TALE nuclease pair BnFAD2_T02
cctctcctctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19482 - DNA, 404 bp, Artificial
  Mutation in BnaC.FAD2.a introduced by TALE nuclease pair BnFAD2_T02
cctctcctccctcaccctctctcctacttcgcctggcctctctactgggcctgccaagggtgcggcctaaccggcgtctgggtcatagcccacgagggcggccaccacgccttcagcgactaccagtggcttgacgacaccgtcgggctcatcttccactccttcctcctcggcccttacttctccgggaagtatctccagcgcctgctttccaccgccattgctggcgatggccaccagtcatcgacgccaccattccaacactggctccctcgagagagacgaagtgtttgtccccaagaagaagtcagacctcacgtggtccggccagtccctcaccacccctttgggacgccccgtgatgttaaccgttcagttcactctcggctggcctttgtccttag

SEQ ID NO: 19483 - DNA, 470 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagcgcctcaaatagatcctgttcaggaaccggatcaaagagttcctccgccgctggacctaccaaggcaacgctatgttctcttgcttttgtcagcaagatagccagatcaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgactggcctttgtacttag

SEQ ID NO: 19484 - DNA, 363 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatcgcccacgaatgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19485 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgaccccgtcggtctcatcttccactccttcctcctcgtcccttacttctcctgaaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19486 - DNA, 349 bp, Artificial
  Mutation in BnaC.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19487 - DNA, 336 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19488 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 19489 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctgtgggacgcaccgtgatgttaacagttcagttcactctcggctagcctttgtacttag

SEQ ID NO: 19490 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 19491 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaataagaagtcagacatcaagtggtacggcaagtacctcaacaaccctttgggacgcaccgtgatgttaacggttcagttcactctcggctggcctttgtacttag

SEQ ID NO: 19492 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtactta

SEQ ID NO: 19493 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccggaagtacagtcatcgacgccaccattccaacactggctccctcgagagagacgaagtgtttgtccccaagaagaagtcagacatcaagtggtacggcaagtacctcagcaaccctttgggacgcaccgtgatgttaacggttcagttcactctcggctggcctttgtacttag

SEQ ID NO: 19494 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagttcctcaacaaccctttggaacgcaccgtgatgttaaccggacagttcactctcgcctggcctttgcacctag

SEQ ID NO: 19495 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcacacatcaagtggtacggaaagttgctcaacatcccttcgggccgccctgtgatgtaaaccgttcagttcactctcgcctggccttagcgcttac

SEQ ID NO: 19496 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgtggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19497 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggccccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19498 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcaatcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19499 - DNA, 346 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19500 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 19501 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19502 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttaatcgtgtcatcgacgccaccattccaacactggctcccttgagagagacgaagtgtttgtccccaagaagaagtcagacatcaagtggtacggcaagtacctcaacatccctttgggacgcaccgtgatgttaaccgctcggttcactctcgcctggcctttgtacttag

SEQ ID NO: 19503 - DNA, 330 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19504 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatctttcactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19505 - DNA, 356 bp, Artificial
  Mutation in BnaC.FAD2.a introduced by TALE nuclease pair BnFAD2_T02
cctctcctccctcaccctctctcctacttcgcctggcctctccactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctccaggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 19506 - DNA, 354 bp, Artificial
  Mutation in BnaC.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccgtcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19507 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19508 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 19509 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccggataccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19510 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgccccgtgatgttcaccgttcagttcactctcggctggcctttgtacttag

SEQ ID NO: 19511 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggcttgacgacaccgtcggtctcatcttccactccttcctcctcgtcccttacttcatcgacgccaccattccaacactggctccctcgagagagacgaagtgtttgtccccaagaagaaatccgacatcaagtggtacggcaagtacctcaacagccctttgtgacgcaccgtgatgttaacggttcagttcactctcggctggcctttgtacttag

SEQ ID NO: 19512 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19513 - DNA, 346 bp, Artificial
  Mutation in BnaC.FAD2.a introduced by TALE nuclease pair BnFAD2_T02
cctctcctccctctccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 19514 - DNA, 357 bp, Artificial
  Mutation in BnaC.FAD2.a introduced by TALE nuclease pair BnFAD2_T02
cctctcctccctcaccctctctcctacttcgcctggcctttctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttggtacgcaccgtgatgttaacggttcagttcactctcggctggcctttgtacttag

SEQ ID NO: 19515 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtccaaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagcccttttggacgcaccgtgatgttaaccggccagtgcacgctcggctggcctttgtacttag

SEQ ID NO: 19516 - DNA, 357 bp, Artificial
  Mutation in BnaC.FAD2.a introduced by TALE nuclease pair BnFAD2_T02
cctctcctccctcaccctctctcctacttcgcttggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19517 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctctctcgagagagacgaagtgtttgtccccaagaagaagtcagatatcaagtggtacggcaagtacctcaacaaccctttgggacgcaccgtgatgttaacggttcagttcactctcggctggcctttgtacttag

SEQ ID NO: 19518 - DNA, 357 bp, Artificial
  Mutation in BnaC.FAD2.a introduced by TALE nuclease pair BnFAD2_T02
cctctcctccctcaccctatcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaggccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19519 - DNA, 357 bp, Artificial
  Mutation in BnaC.FAD2.a introduced by TALE nuclease pair BnFAD2_T02
cctctcctccctcaccctatccactacttcgcctggcctctcaactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 19520 - DNA, 355 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcacacgagtgcggccaccacgccttcagcgactaccagtggcttgacgacaccgtcggtctcatcttccactccttcctcctcgtcccttacttctcctggaagtaaggcacgccaccattccaacactggctccctcgagagagacgaagtgtttgtccccaagaagaagtcagacatcaagtggtacggcaagtacctcgacaaccctttgggacgcaccgtgatgttagcggttcagtgcactctcggcgggcctttgtacttg

SEQ ID NO: 19521 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggactttgtacttag

SEQ ID NO: 19522 - DNA, 311 bp, Artificial
  Mutation in BnaC.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccttcagcgactaccagtggcttaacgacaccgtcggtctcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19523 - DNA, 409 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaccttgaccgaacgcagcggtggtaacggcgcagtggcggttttcatggcttgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19524 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgcctttgtacttag

SEQ ID NO: 19525 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19526 - DNA, 339 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccaccatttcaacactggcttcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19527 - DNA, 360 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19528 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19529 - DNA, 357 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttggacttag

SEQ ID NO: 19530 - DNA, 332 bp, Artificial
  Mutation in BnaC.FAD2.a introduced by TALE nuclease pair BnFAD2_T02
cctctcctccctcaccctctcccttacctcgccttgcccctctactgggcctgccacggctgcgtcctaccgggcctctgggtcatcgcccacgaatgcggccaccacgccttcagcgactaccagtggctttacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgttaacggtgcaggtcactctcggctggcctttgtacttag

SEQ ID NO: 19531 - DNA, 336 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19532 - DNA, 355 bp, Artificial
  Mutation in BnaC.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggactcatcgacgccaccattccaacactggctccctcgagagagacgaagtgtttgtccccaagaagaagtcagacatcaagtggtacggcaggtacctcaacaaccctttgggacgccccgtgatgttaacggttcaggtcactctcggctgccttttgtacgtag

SEQ ID NO: 19533 - DNA, 476 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagggcctggcacagcaccggcaacagccgcaatggcgggcgtcaaactaaacagtgttgggatggtggcgtcgatgactgtgagtccaacccggtaagacacgacttatcgccactggcagcagccactggtaacaggattagcagagcgaggtatgtaggcggtaagtcgtgtgtccccaagaagaagtcagacatcaagtggtacggcaagtacctcaacaaccctttgggacgcaccgtgatgttaacggttcagttcactctcggctggcctttgtacttag

SEQ ID NO: 19534 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 19535 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19536 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19537 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactactagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 19538 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctggatcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19539 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19540 - DNA, 357 bp, Artificial
  Mutation in BnaC.FAD2.a introduced by TALE nuclease pair BnFAD2_T02
cctctgctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcgggctcatcttccactccttcctcctcgtcccttacttctcctggaaagtcatcgacgccaccattccaacacaggctccctcgagagagacgaagtgtttgcccccaagaagaagtcacacatcaagtggtacggcaagtacctcaacaaccctttgggacgcaccgggatgttaacggttcagttcactctcggctggcctttgtacttag

SEQ ID NO: 19541 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctactcgtcccctacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19542 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 19543 - DNA, 359 bp, Artificial
  Mutation in BnaC.FAD2.a introduced by TALE nuclease pair BnFAD2_T02
cctctcctccctcaccctctctcctacttcgcctggcctctccactgggcctgccaagggcgcgccctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcgacatccctttgggacgcactgtgatgttaacggttcagttgacgctcggctggcctttgtacttag

SEQ ID NO: 19544 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 19545 - DNA, 345 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19546 - DNA, 311 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgtctttgtccccaagaagaagtcagacatcaagtggtacggcaagtacctcaacaaccctttgggacgcaccgtgatgttaacggttcagttcactctcggctggcctttgtacttag

SEQ ID NO: 19547 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaaggatgcgtcctaaccggcgtctgggtcatagcccacgagtgcggccaccacgccttcagcgactaccagtggcttgacgacaccgtcggtctcatcttccactccttcctcctcgtcccgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19548 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19549 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19550 - DNA, 409 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagtgactaccagtggcttgacgacaccgtcggtctcatcttccactccttcctcctcgtcccttacttctcctggagcaacagccgctggaccgtctccagcgcctgcttgccgccatcgtggctggcgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19551 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19552 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaactcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19553 - DNA, 412 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19554 - DNA, 356 bp, Artificial
  Mutation in BnaC.FAD2.a introduced by TALE nuclease pair BnFAD2_T02
cctctcctccctcaccctctctcctacttcgcctagcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19555 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19556 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggctgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19557 - DNA, 356 bp, Artificial
  Mutation in BnaC.FAD2.a introduced by TALE nuclease pair BnFAD2_T02
cctcttctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19558 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtaccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19559 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtccagttcacgctcggctggcctttgtacttag

SEQ ID NO: 19560 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtagtacggaaagtacctcaacaacccgctaggacgcatggtgatgctaaccgtccagttcacgctcggctggccgttgtacttag

SEQ ID NO: 19561 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19562 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 19563 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacgtttcagttcactctcggctggcctttgtacttag

SEQ ID NO: 19564 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 19565 - DNA, 291 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaactgtttgtccccaagaagaagtcagacatcaagtggtacggcaagtacctcaacaacccgctatgacgcaccgtgatgttaacggttcagttcactctcggctggcctttgtacttag

SEQ ID NO: 19566 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggttcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19567 - DNA, 347 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19568 - DNA, 357 bp, Artificial
  Mutation in BnaC.FAD2.a introduced by TALE nuclease pair BnFAD2_T02
cctctcctccctcaccctttctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcacttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctttgtacttag

SEQ ID NO: 19569 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19570 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19571 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccactagtgcggccaccacgccttcagcgactaccagtggcttgacgacaccgtcggtctcatcttccactccttcctcctcgtcccttacttctcctggaagtagtcatcgacgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtacttag

SEQ ID NO: 19572 - DNA, 356 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 19573 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaaatccgacatcaagtggtacggaaagtacctcaacaacccgctaggacgcacggtgatgctaacggtccagttcacgctcggctggcctttgtacttag

SEQ ID NO: 19574 - DNA, 312 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19575 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgcccccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttat

SEQ ID NO: 19576 - DNA, 362 bp, Artificial
  Mutation in BnaC.FAD2.a introduced by TALE nuclease pair BnFAD2_T02
cctctcctccctcaccctctctcctacttcgcctggcaactctactgggcctgccaagggtgcgtcctaaccgccgtctgggtcatcgcccacgagtgcggccaccacgccttcagcgactaccagtggcttgacgacaccgtcggtctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaagccggtgggacgcaccgggatgttaaccgtccaggtcacgctcggctggcctttgtacttag

SEQ ID NO: 19577 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcgcccaccacgccttcagcgactaccagtggcttgacgacaccgtcggtctcatcttccactccttcctcctcgtcccttgcttctccacgacgccaccattccaacactggctccctcgagagagacgaagtgtttgtccccaagaagaagtcagacatcaagtggtacggcaagtacctcaacaaccctttgagacgcaccgtgatgttaacggttcagttcactctcggctggcctttgtacttag

SEQ ID NO: 19578 - DNA, 357 bp, Artificial
  Mutation in BnaC.FAD2.a introduced by TALE nuclease pair BnFAD2_T02
cctctcctccctcaccctctcccttacctagcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19579 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtccacgatcacgccgtagtcgatgggggagcccaatcctgttgccggtcttgcgatgattatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19580 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaacggcgtctgggtcatagcccacgagtgcggccaccacgccttcagcgactaccagtggcttgacgacaccgtcggtctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacgtttcaggtcactttcgtcgggccgttgtacttag

SEQ ID NO: 19581 - DNA, 363 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19582 - DNA, 321 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19583 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19584 - DNA, 356 bp, Artificial
  Mutation in BnaC.FAD2.a introduced by TALE nuclease pair BnFAD2_T02
cctctcctccctcaccctctctcctacctcgcctggcccctctactgcgcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19585 - DNA, 421 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactcctccctcctcgtcccttacttctcctggaagtaaggtttcatttagcgcctcaaatagatcctgttcaggaaccggatcaaagagttcctccgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19586 - DNA, 356 bp, Artificial
  Mutation in BnaC.FAD2.a introduced by TALE nuclease pair BnFAD2_T02
cctctcctccctcaccctctccattacctcgcctggtccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19587 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgttgtccccaagaagaagtcagacatcaagtggtacggcaagtacctcaacaaccctttgggacgcaccgtgatgttaacggttcagttcactctcggctggcctttgtacttag

SEQ ID NO: 19588 - DNA, 365 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19589 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19590 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcatttgtacttag

SEQ ID NO: 19591 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccaacactggctccctcgagagagacgaagtgtttgtcctcaagaagaagtcagacatcaagtggtacggcaagtacctcaacaaccctttgggacgcaccgtgatgttaacggttcagttcactctcggctggcctttgtacttag

SEQ ID NO: 19592 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 19593 - DNA, 357 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19594 - DNA, 358 bp, Artificial
  Mutation in BnaC.FAD2.a introduced by TALE nuclease pair BnFAD2_T02
gctctcctccctcaccctctcccttacctcgcctggcccctctacagggcaggggaaggctgcgtactaacgggcctctggggcagcgcccacgagggaggccacaacgccttcagcgactaccagtggcttgacgacaacgtcgggctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19595 - DNA, 357 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtccggcaagtacctcaacaacccttcgggacgcaccgtgatgttaacggttcagttcactctcggctggcctttgtacttag

SEQ ID NO: 19596 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 19597 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatattccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19598 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagtccacgagtgcggccaccacgccttcagcgactaccagtggcttgacgacaccgtcggtctcatcttccactccttcctcctcgtcccttacttctcctgggcgctcggtcgttcggctgcggcgagcggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19599 - DNA, 321 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19600 - DNA, 355 bp, Artificial
  Mutation in BnaC.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19601 - DNA, 356 bp, Artificial
  Mutation in BnaC.FAD2.a introduced by TALE nuclease pair BnFAD2_T02
cctctcctccctcaccctctctactacttcgcctggcctctctactgggcctgccaagggcgcgtcctaaccggcgtctgggtcacagcccacgagtgcggccaccacgcctacagcgactaccagtgacttgacgacaccgtcggtctcatcttccactccttcctcctcgtcccttacttctcctggaagtcatcgacgccaccattccaacactggctccctcgagagagacgaagtgtttgtccccaagaagaagtcacacatcaagtggtacggaaagtacctcaacagccctttgggacgcagcgtgatgttaacggttcagttcactctcggctggcctttgtacttag

SEQ ID NO: 19602 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctggttcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19603 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19604 - DNA, 352 bp, Artificial
  Mutation in BnaC.FAD2.a introduced by TALE nuclease pair BnFAD2_T02
cctctcctccctcaccctctctcctacttcgcctggcttctctactgggcctgccaagggtgcgtcctaaccggcgtctggatcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19605 - DNA, 392 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggagactgagcctttcgttttatctgttgtttgtcggtgaacgctcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19606 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttggaacgcaccgtgatgttaacgtttcagttcactctcggctggcctttagacttag

SEQ ID NO: 19607 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctactggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19608 - DNA, 356 bp, Artificial
  Mutation in BnaC.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19609 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19610 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19611 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19612 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19613 - DNA, 358 bp, Artificial
  Mutation in BnaC.FAD2.a introduced by TALE nuclease pair BnFAD2_T02
cctctcctccctcaccctctcccttacctcgcctggaccctctactgggcctgcaaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19614 - DNA, 443 bp, Artificial
  Mutation in BnaC.FAD2.a introduced by TALE nuclease pair BnFAD2_T02
cctctcctccctcaccctctctcctacttcgcctaccctctctactgggcctgccaagggcgcgcactacccgccgtctgggtcatcgcccacgagtgcgtccaccacgccttcagcgactaccagtggcttgacgacaccgtcggtctcatcttccactccttcctcctcgtcccttacttctcctggaagtactgtgccaggcccacggcttgaccccccagcaggtggtggccatcgccagcaattgcggtggcaagcaggcgctggagacggtagtcatcgacgccaccattccaacactggctccctcgagagagacgaagtggttgtccccaagaagaagtcagacatcaagtggtacggcaagtagctcgacggccctgtgggacgcaccgtaatgttaacggttcagttcactctcggctggccttggtacttag

SEQ ID NO: 19615 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacgattcagttcactctcggctggcctttgtacttag

SEQ ID NO: 19616 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 19617 - DNA, 357 bp, Artificial
  Mutation in BnaC.FAD2.a introduced by TALE nuclease pair BnFAD2_T02
cctctcctccctcaccctgtctactacttcgcctggcctctctactgggcctgccaagggtgcgtcctaaccggcgtctgggtcacagcccacgagtgcggccaccacgccttcagcgactaccagtggcttgacgaccccgtcgttctcctcttccactccttcctcctcgtcccttacttctcctggacagtcatcgactccaccattccaacactggctccctcgagagagacgaagtgtttgtccccaagacgaagtcagccctcaagtggtacgtgaagttcctcaacacccctttgggacgcaccgtgatgttaacggttcagtggactctcggctggcatttgtacttag

SEQ ID NO: 19618 - DNA, 358 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacatccctttgggacgcaccgtgattttaacggttcagttcactctcggctggcctttgtacttag

SEQ ID NO: 19619 - DNA, 402 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggactgccgctgccaagttcgagagacagcacatggacagcatcgatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19620 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19621 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 19622 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaagtcagacatcaagtggtacggcaagtacctcaacagccctttgggacgcaccgtgatgttaacggttcagttcactctcggctggcctttgtacttag

SEQ ID NO: 19623 - DNA, 343 bp, Artificial
  Mutation in BnaC.FAD2.a introduced by TALE nuclease pair BnFAD2_T02
cctctcctccctcaccctctcccttacctcgtctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagcagtcacacatcaagtggttcgccacgtcgcccaacacgcctttgggacatacggtgctgtttccggtcccgttccctctcggctggcctttgtacttag

SEQ ID NO: 19624 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19625 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaccggttcagttcactctcggctggcctttgtacttag

SEQ ID NO: 19626 - DNA, 345 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagtccacgagtgcggccaccacgccttcagcgactaccagtggcttgacgacaccgtcggtctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19627 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 19628 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19629 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19630 - DNA, 396 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcaatttgttgcaacgaacaggtcactatcagtcaaaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19631 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgttgggacgcaccgtgatgctaaccgtccagttcacgctcggctggcctttgtacttag

SEQ ID NO: 19632 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19633 - DNA, 330 bp, Artificial
  Mutation in BnaC.FAD2.a introduced by TALE nuclease pair BnFAD2_T02
cctctcctccctcaccctctctcctacttcgcctggcctctctactcggcctgccaagggtgcgtcctaaccggcgtctgggtcatagcccacgagtgcggccaccacgccttcagcgactaccagtggcttgacgacaccgtcggtctcatcttccactccttcctcctcgtcgccaccattccaacaccggatccctcgagagggatgaagtgttcgtccccaagaagaaatccgacatcaagtggtacggaaagtacctcaacaacccgctaggacggacggtgatgcttaccgtccagttcacgctcggctggcctttgtacttag

SEQ ID NO: 19634 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtccattacttctcctggaagttacagtcatcgacgccaccattccaacactggctccctcgagagagacgaagtgtttgtccccaagaagaagtcagacatcaagtggtacggcaagtacctcaacacccctttgggacgcaccgggatgttaacggttcagttcactctcggctggcctttgtacttag

SEQ ID NO: 19635 - DNA, 416 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacaggccaacttctcaagattgcaaaacgtggcggcgtgaccgcagtggaggtacagtcatcgacgccaccattccaacactggctccctcgagagagacgaagtgtttgtccccaagaagaagtcagacatcaagtggtacggcaagtacctcaacaaccctttggaacgcaccgtgatgttatcggttcatttcactcgccgctggccttagtacttag

SEQ ID NO: 19636 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtctgtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19637 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19638 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19639 - DNA, 403 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcaagatcgcttggcctcgcgcgcagatcagttggaagaatttgtccgtcatcgacgccaccattccaacactggctccctcgagagagacgaagtgtttgtccccaagaagaagtcagacatcaagtggtacggcaaggacctcaacaaccctatgggacgcaccgtgatgttaacggttcagttcactctcggctggccgttgtacttag

SEQ ID NO: 19640 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 19641 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacattgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 19642 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagacagacatcaagtggtacggcaagtacctcaacaaccctttgggacgcaccgtgaggttaacggttcagttcactctcggctggccttagtacttag

SEQ ID NO: 19643 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19644 - DNA, 321 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgatggccaccacctgctgaggggtcaagccgtgggcctggcacagcaccggcaacagccgctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcagtctcggctggcctttgtacttag

SEQ ID NO: 19645 - DNA, 364 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19646 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacactggctccctcgagagagacgaagtgtttgtccccaagaagaagtcagacatcaagtggtacggcaagtacctcaacaaccctgtgggacgcgccgtgatgttaacggttcagttcactctcggctggcctttgtacttag

SEQ ID NO: 19647 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctctcagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19648 - DNA, 356 bp, Artificial
  Mutation in BnaC.FAD2.a introduced by TALE nuclease pair BnFAD2_T02
cctctcctccctcaccctctctcctacttcgcctggcctctctactgggcctgtcaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19649 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccaccattccaacaccggatccctcgatagggacgaagtgttcgtccccaagaagaaatccgacatcaagtggtacggcaagtacctcaacaacccgctaggacgcccggtgatgctaaccgtccagttcaagctcggctggcctttgtacttag

SEQ ID NO: 19650 - DNA, 363 bp, Artificial
  Mutation in BnaC.FAD2.a introduced by TALE nuclease pair BnFAD2_T02
cctctcctccctcaccctctctcctacttcgcctggccactctactgggcctgccaagggtgcgtcctaaccggcgtctgggtcatagcccacgagtgcggccaccacgccttcagcgactacaagtggcttgacgacaccgtcggtctcatcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactcgcggctggcctttgtacttag

SEQ ID NO: 19651 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagttgcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19652 - DNA, 467 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggaaagcgggcagtgagcgcaacgcaattaagctcgccgcgttgtttcatcaagccttacggtcaccgtaaccagcaaatcaatatcactgtgtggcttcaggccgccagtcatcgacgccaccattccaaccctggctccctcgagagagacgaagtgtttgtccccaagaagaagtcagacatcaagtggtacggcaagtaccgcaacaacccgttgggacgcaccgtgatgttaacggttcagttcactctcgggtggcatttgtacgtag

SEQ ID NO: 19653 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttcacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacacccctttgggacgcacggtgatgctaaccgtccagttcacgctcggctggcctttgtacttag

SEQ ID NO: 19654 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19655 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgagacgcaccgtgatgttaacggttcagttcactctcggctggccgttgtacttag

SEQ ID NO: 19656 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgaaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19657 - DNA, 355 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19658 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 19659 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccgaggctgcgtcctaacgggcctctgggtcatcgcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19660 - DNA, 351 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19661 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagagtttgtccccaagaagaagtcagacatcaagtggtacggcaagtacctcaacaaccctttgggacgcaccgtgatgttaacggttcagttcactctcggctggcctttgtacttag

SEQ ID NO: 19662 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19663 - DNA, 471 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcgccagccacgatggcggcaagcaggcgctggagacggtccagcggctgttgccggtgctgtgccaggcgatggccaccacctgctccggggtcaagccgtgggcctggcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19664 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19665 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagacagacatcaagtggtacggcaagtacctcaacaaccctgtgggccgcgccgggatggtaacggttcagttgactctcggcgggcctttgtacgtag

SEQ ID NO: 19666 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtcttggtcatagcccacgagtgcggccaccacgccttcagcgactaccagtggcttgacgacaccgtcggtctcatcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 19667 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggccgttgtacttag

SEQ ID NO: 19668 - DNA, 400 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtctccaaattgcagttcgcgcttagctggataacgccacggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19669 - DNA, 359 bp, Artificial
  Mutation in BnaC.FAD2.a introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 19670 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgaaaatcgacgccaccattccaacactggctccctcgagagagacgaagtgtttgtccccaagaagaagtcagacatcaagtggtacggcaagtacctcaacatcccgctaggacgcacggtgatgctaaccgtccagttcacgctcggctggcctttgtacttag

SEQ ID NO: 19671 - DNA, 356 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19672 - DNA, 427 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaggcggtaatacggttatccacagaatcaggggataacgatatcgatgctgtccatgtgctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19673 - DNA, 322 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19674 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaagtccgacatcaagtggtacggcaagtacctcaacaacccttggggacgcaccgtgatgttaacggttcagttcactctcggctggcctttgtacttag

SEQ ID NO: 19675 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19676 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 19677 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19678 - DNA, 405 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatgttgccaccgccattgctggcgatggccaccacctgctggggggtcaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19679 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcatggtgatgctaaccgtccagttcacgctcggctggcctttgtacttag

SEQ ID NO: 19680 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19681 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgcgaccattccaacactggctccctcgagagagacgaagtgtttgtccccaagaagaagtcagacatcaagtggtacggcaagtacctcaacgcccctttgggacgcgccgtgaggttaacggttcagttcactctcggctggcttttgtacttag

SEQ ID NO: 19682 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19683 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19684 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 19685 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 19686 - DNA, 407 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacggtgctgttccgggcgatctcgatcagctcgatgtactcgtgggacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19687 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19688 - DNA, 469 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagccagcaataatggtggcaagcaggcgctggagacggtccagcggctgttgccggtgctgtgccaggcccacggcttgaccccccagcaggtggtggccatcgccattgaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19689 - DNA, 356 bp, Artificial
  Mutation in BnaC.FAD2.a introduced by TALE nuclease pair BnFAD2_T02
cctctcctccctcaccctctctcctacttcgcctggcctcactactgggcctgacaagggtgcgtcctaaccggcgtctgggtcatagcccacgagtgcggccaccacgccttcagcgactaccagtggcttgacgacaccgtcggtctcatcttccactccttcctcctcgtcccttacttctcctggaactcatcgacgccaccattccaacactggctccctcgagagagacgaagtgtttgtccccaagaagaagtcagacatcaagtggtacggcatgtacctcaacaacccttggggacgcgccgtgatgttaacggttcagttcactctcggctggcctttgtacttag

SEQ ID NO: 19690 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19691 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcatctacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19692 - DNA, 345 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcggcgactaccagtggcttgacgacaccgtcggtctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19693 - DNA, 439 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgattgcggccaccacgccttcagcgactaccagtggcttgacgacaccgtcggtctcctcttccactccttcctcctcgtcccttacttctcctggaaagtccagcgcctgcttgccaccgccattgctggcgatggccaccacctgctggggggtcaagccgtgggcctggcacagcaccggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19694 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctaggagtatcgacgccaccattccaacacttgctccctcgagagagacgaagtgtttggccccaattataaatcagacatcaagtggtacggcaagtaccgcaacaaccctttgggacgcaccgtgatgttatcgggacagttctctcccggctggcctttgtacttat

SEQ ID NO: 19695 - DNA, 363 bp, Artificial
  Mutation in BnaC.FAD2.a introduced by TALE nuclease pair BnFAD2_T02
gcctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaatactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19696 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggccatagcccacgagtgcggccaccacgccttcagcgactaccagtggcttgacgacaccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19697 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctgtgggacgcaccgtaatgttaacggttcagttcactctcggctggcctttgtacttag

SEQ ID NO: 19698 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19699 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 19700 - DNA, 442 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagcaggtggtggccatcgccagcaatggcggtggcaagcaggcgctggagacggtccagcggctgttgccggtgctgtgccaggcccagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 19701 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagccatcgacgccaccattccaacaccggatccctcgagagggatgaagtgttcgtccccaagaagaaatccgacagcaagtggtacggaaagtacctcaacaacccgcgaggacgcacggtgatgctaaccgtccagttcacgctcggctggccgttgtacttag

SEQ ID NO: 19702 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtggtgttaacggttcagttcactctcggctggcctttgtacttag

SEQ ID NO: 19703 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgtcttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19704 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 19705 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagctactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19706 - DNA, 420 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtactggaccgtctccagcgcctgcttgaaagataccaggcgtttccccctggaagctccctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19707 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaaggacctcaacaaccctttggaacgcaccgtgaggttaacggttcagttcactctcggctggcctttggacttag

SEQ ID NO: 19708 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaacggcgtctgggtcatagcccacgagtgcggccaccacgccttcagcgactaccagtggcttaacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttggggcgcaccgtgatgtgaacggttcagttcactctcggctggcctttgtacttag

SEQ ID NO: 19709 - DNA, 400 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtctccaaattgcagttcgcgcttagctggataacgctacggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19710 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19711 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggatacagtcatcgacgccaccattccaacactggctccctcgagagagacgaagtgtttgtccccaagaagaagtcagacatcaagtggtccggcaagtacctcaaccgccctttgggacgaaccgtgatgttaacggttcagttcactctcggctggcctttgtacttag

SEQ ID NO: 19712 - DNA, 458 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagaccgtctccagcgcctgcttgccgccatcgtggctggcgatggccaccatgtgctcacgcaaaaaggccatccgtcaggatggccttctgcttagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19713 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtacaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19714 - DNA, 356 bp, Artificial
  Mutation in BnaC.FAD2.a introduced by TALE nuclease pair BnFAD2_T02
cctctcctccctcaccctctcccttacctcgcctggcccctctactcggcctgccaaggctgcgtcctaacgagcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtattag

SEQ ID NO: 19715 - DNA, 357 bp, Artificial
  Mutation in BnaC.FAD2.a introduced by TALE nuclease pair BnFAD2_T02
cctctcctccctcaccctctctcctacttcgcctggcctctctactgggcatgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19716 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcaacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19717 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19718 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 19719 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19720 - DNA, 428 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctccagcgcctgcttgccaccattattgctggcgatggccaccacctgctggggggtcaagccgtgggcctggcacagcacctggacgccaccattccaacactggctccctcgagagagacgaagtgtttgtctccaagaagaagtcagacatcaagtggtacggcaagtacctcaacaaccctttgggacgcaccgtgatgttaacggttcagttcactctcggctggcctttgtacttag

SEQ ID NO: 19721 - DNA, 357 bp, Artificial
  Mutation in BnaC.FAD2.a introduced by TALE nuclease pair BnFAD2_T02
cctctcctccctcaccctctaccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggcctttgtacttag

SEQ ID NO: 19722 - DNA, 322 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggaaagtacctcaacaacccgctaggacgcaccgtgatgttaacggttcatttcactctcggctggccgttgtacttag

SEQ ID NO: 19723 - DNA, 353 bp, Artificial
  Mutation in BnaC.FAD2.a introduced by TALE nuclease pair BnFAD2_T02
cctctcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggccgttgttcttag

SEQ ID NO: 19724 - DNA, 434 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatggcggtggccaccacctgctggggggccaagccgggggccgggcacagcaccggcaacagccgctggaccgcctggctcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 19725 - DNA, 441 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagctcggtttgatcgacagtggcgcagcaccacgaggcactggtcggccacgggtttacacacgcgcacatcgttgcgtgaagccagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 19726 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19727 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctaggctggcctttgtacttag

SEQ ID NO: 19728 - DNA, 357 bp, Artificial
  Mutation in BnaC.FAD2.a introduced by TALE nuclease pair BnFAD2_T02
cctctcctccctccccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacaccaagtggtacggcaagtacctcaacaaccccttgggccgcgtcgggatgttaacggttcagttcacttccggttggccgttgtacgtag

SEQ ID NO: 19729 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19730 - DNA, 407 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacggtgctgttccgggcgatctcgatcagctcgatgtactcgtgggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19731 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcgagtggtacggcaagtacctcaacaaccctctggaacgcaccgtgattttaacggttcagttcactctcgcctggcctgagcacttag

SEQ ID NO: 19732 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19733 - DNA, 356 bp, Artificial
  Mutation in BnaC.FAD2.a introduced by TALE nuclease pair BnFAD2_T02
cctctcctccctcaccctctcacctacttcgcctgaactatctactgggcctgccaagggtgcgtcctaaccggcgtctgggtcatagcccacgagggcggccaccacgccttcagcgactaccagtggcttgacgacaccgtcggcctcatcttcaactccttcctcctcgtcccttacttctcctggaagtcatcgacgccaccattccaacactggctccctcgagagagacgaagtgtttgtccccaagaagaagtcagacatcaagtggtacggcaagtacctcagcaaccctttgggacgcaccgtgatgttaacggttcagttcactctcggctggcctttgtacttag

SEQ ID NO: 19734 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19735 - DNA, 356 bp, Artificial
  Mutation in BnaC.FAD2.a introduced by TALE nuclease pair BnFAD2_T02
cctctcctccctcaccctctctcctacttcgcctggcctctttactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19736 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacaaagtgtttgtccccaagaagatgtcggacatcaagtggtacggcaagtacctcaacaacccgttggaacgcaccgtgatgttaacggttcagttcactctcggctggcctttgtacttag

SEQ ID NO: 19737 - DNA, 332 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19738 - DNA, 365 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcagtacaaacagccatcgacgccaccattccaacaccggatccctcgagagagacgaactgtctgtccccaagaagcagtcacacatcaagtggtacggcaagtacctcaacatccctccgggccgcaccctgatgttaacggttcagttcactctcggctggcctttgtacttag

SEQ ID NO: 19739 - DNA, 331 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19740 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 19741 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 19742 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19743 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19744 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctatgggtcatcgcccacgaatgcggccaccacgccttcagcgaccaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19745 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 19746 - DNA, 323 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 19747 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgatgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctgtgtacttag

SEQ ID NO: 19748 - DNA, 353 bp, Artificial
  Mutation in BnaC.FAD2.a introduced by TALE nuclease pair BnFAD2_T02
cctctcctccctcaccctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 19749 - DNA, 392 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggcctggcacagcaccggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19750 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggagcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19751 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaattgttgccggtgctgtgccaggcccacggcttgaccccggagcaggtggtggccatcgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19752 - DNA, 399 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtagccgaagtttccaaaaggtcgttgatcaaagctcgccgcgttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19753 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgatgacaccgtcggtctcctcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19754 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacaacccgctaggacgcaccgtgatgttaacggttcagttcactctcggctggcctttgtacttag

SEQ ID NO: 19755 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttggggacgcaccgtgaggttaacggttcagttcactctcggctggcctgtgtacttag

SEQ ID NO: 19756 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactcctttctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19757 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcgcctggcctttgtacttag

SEQ ID NO: 19758 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttcacgacaccgtcggtctcatcttccactccttcctccacgtcccttacttctcctggaagtcatcgacgcccccattccaacactggctccctcgagagagacgaagtgtttgtccccaagaagaagtcagacatcaagtggtacggcaagtacctcaacatcccttcgggacgcaccgtgatgtttacggttcagttcactctcggctggcctttgtacttag

SEQ ID NO: 19759 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgaggttaacggttcggttcactctcggctggcctttgtacttag

SEQ ID NO: 19760 - DNA, 358 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 19761 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19762 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagggcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19763 - DNA, 366 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaatcagaaaaggtccactgggttcgtgccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19764 - DNA, 439 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccggtgctgtgccaggcccacggcttgaccccggagcaggtggtggccatcgccagccacgatggcggcaagcaggcgcagtcatcgacgccaccattccaacactggctccctcgagagagacgaagtgtttgtccccaagaagaagtcagacatcaagtggtacggcaagtacctcaacaaccctttggggcgcaccgtgatgttaacggttcagttcactctcggctggcctttgtacttag

SEQ ID NO: 19765 - DNA, 363 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtatctcaacaaccctttgggacgcaccgtgatgttaacggttcagttcactctcggctggcctttgtacttag

SEQ ID NO: 19766 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctgggctggcctttgtacttag

SEQ ID NO: 19767 - DNA, 356 bp, Artificial
  Mutation in BnaC.FAD2.a introduced by TALE nuclease pair BnFAD2_T02
cctcttctccctcaccctctatcctacttcgcctggcctctctactgcgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagagacgaagtgtttgtccccaagaagaaatccggcatcaagtggtacggaaagtacctcaacaacccgctaggacggagggtgattctaaccgtccagttcacgctcggctggcctttgtgcttag

SEQ ID NO: 19768 - DNA, 356 bp, Artificial
  Mutation in BnaC.FAD2.a introduced by TALE nuclease pair BnFAD2_T02
cctctcctcactcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19769 - DNA, 359 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttaagcgactaccagtggcttgacgacaccgtcggtctcatcttccactcattcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19770 - DNA, 412 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctattattattccaccaggtggtggccatcgccagcaataatggtggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19771 - DNA, 387 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccaagccccccagcaggtggtggccatcgccagcgatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19772 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 19773 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcgccgtaatgttaacggttcaggtcactctcggctggcctttgtacttag

SEQ ID NO: 19774 - DNA, 357 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatctcccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttatcggttcagttcactctcggctggcctttgtacttag

SEQ ID NO: 19775 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttccctctcggctgccctttgtacttag

SEQ ID NO: 19776 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 19777 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19778 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 19779 - DNA, 344 bp, Artificial
  Mutation in BnaC.FAD2.a introduced by TALE nuclease pair BnFAD2_T02
cctctcctccctcaccctctctcctacttcgcctggcctctctactgggcctaccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19780 - DNA, 412 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgctgaaccacatcaccaactgcaacggcgccgtgctgtccgtggaggagctccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19781 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccattacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19782 - DNA, 356 bp, Artificial
  Mutation in BnaC.FAD2.a introduced by TALE nuclease pair BnFAD2_T02
ccgctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagcagtcacacatcaactggtacggcaagtacctcaacaaccctttgggacgcaccgtgaggttaacggctcagttccctctcggctgccctttgtacttag

SEQ ID NO: 19783 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttcacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacagccctttgggacgcgcggtgatgctaaccgtccagttcacgctcgtctggcctttgtacttag

SEQ ID NO: 19784 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19785 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19786 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 19787 - DNA, 365 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaacagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 19788 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19789 - DNA, 356 bp, Artificial
  Mutation in BnaC.FAD2.a introduced by TALE nuclease pair BnFAD2_T02
cctctcctccctcaccctctcccttacctcgcccggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19790 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttcacgacaccgtcggtctcctcttccactccttcctcctcgtcccttacttctcctggaaagtcatcgacgccaccattccaacactggctccctcgagagagacgaagtgtttgtcccctagaagaagtcacacatcgactggttcggcaagttcctcaacatccctttgggacgccccgtgaggttaacggttcaggtcactcccggctggcctcagtgcttag

SEQ ID NO: 19791 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcctcttccactccttcctcctcgtcccttacttctcctgaaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19792 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19793 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 19794 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19795 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtccacgatcacgccgtagtcgatgggggagcccaatcctgttgccggtcttgcgatgattatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19796 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccttttgggacgcaccgtgatgttaacggttcagttcactctcggctggcctttgtacttag

SEQ ID NO: 19797 - DNA, 344 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 19798 - DNA, 303 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcataacgggcctctgggtcatcgcccacgaatgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19799 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 19800 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19801 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatcttaacggttcagttcactctcggctggcctttgtacttag

SEQ ID NO: 19802 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcaacgacgccaccattccaacactggctccctcgagagagacgaagtgtttgtccccaagaagaagtcagacatcaagtggtacggcaagtacctcaacaaccctttgggacgcatcgggatgttaacggttcagttcactctgggcgggcctttgtacttag

SEQ ID NO: 19803 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtaggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19804 - DNA, 291 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 19805 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19806 - DNA, 409 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaccttgaccgaacgcagcggtggtaacggcgcagtggcggttttcatggcttgagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19807 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 19808 - DNA, 354 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19809 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 19810 - DNA, 358 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19811 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcgccgtgagtttaacagttaagttcactcccggctggcctttgtacttaa

SEQ ID NO: 19812 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcacatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19813 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 19814 - DNA, 360 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19815 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcctcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggccttagtacttag

SEQ ID NO: 19816 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacacccctttgggacgcaccgggatgttaacggttcagttcactctcggctggcctttgtacttag

SEQ ID NO: 19817 - DNA, 359 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 19818 - DNA, 412 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcctcttccactccttcctcctcgtcccttacttctcctattattattccaccaggtggtggccatcgccagcaataatggtggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19819 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtgcctcaacaacccgctaggacgcacggtgatgctaaccgtccagttcacgctcggctggcctttgtacttag

SEQ ID NO: 19820 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19821 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19822 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgaggttaaccgttcagttcactcgcggctggcctgtgtacttag

SEQ ID NO: 19823 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19824 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19825 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctagccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccggttcacgctcggctggcctttgtacttag

SEQ ID NO: 19826 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19827 - DNA, 356 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19828 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggctttgtacttag

SEQ ID NO: 19829 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctttacgacaccgtcggtctcatcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19830 - DNA, 407 bp, Artificial
  Mutation in BnaC.FAD2.a introduced by TALE nuclease pair BnFAD2_T02
cctcttctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacggtgctgttccgggcgatctcgatcagctcgatgtactcgtgggacagtcatcgacgccaccattccaacactggctccctcgagagagacgaagtgtttgtccccaagaagaagtcagacatcaagtggtacggcaagtacctcaacaaccctttgggacgcaccgtaatgttaacggttcagttcactctcggctggcctttgtccgtag

SEQ ID NO: 19831 - DNA, 402 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19832 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctcctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 19833 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggccgttgtacttag

SEQ ID NO: 19834 - DNA, 400 bp, Artificial
  Mutation in BnaC.FAD2.a introduced by TALE nuclease pair BnFAD2_T02
cctctcctccctcaccctctctcctacttcgcctggcttctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtctccaaattgcagttcgcgcttagctggataacgccacggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19835 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggcacggcaagtactccaccacccctgtggtacgcaacgtgatgttaacgcttcagttcactctcggctggcctttgtacttag

SEQ ID NO: 19836 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19837 - DNA, 355 bp, Artificial
  Mutation in BnaC.FAD2.a introduced by TALE nuclease pair BnFAD2_T02
cctctcatccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19838 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19839 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaaatccgacatcaagtggtacggaaagtacctcaacaacccgctaggacgcacggtgatgctaaccgtccaggtcacgctcggctggcctttgtacttag

SEQ ID NO: 19840 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgttgttaacggttcagttctctctcggcgggcctttgtacttag

SEQ ID NO: 19841 - DNA, 347 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19842 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 19843 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 19844 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19845 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 19846 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggcaatagcccaggagtgcggctaccacgccttcagcgactaccaggggcttgacgacaccgtcggtctcatcttccactccttcctcctcgtcccttacttctcctggcatcgacaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19847 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 19848 - DNA, 358 bp, Artificial
  Mutation in BnaC.FAD2.a introduced by TALE nuclease pair BnFAD2_T02
cctttcctccctcaccctctctcctacttcgcctggcctctctactgggcctgccaagggtgcgtcctaaccggcgtctgggtcatagcccacgagtgcggccaccacgccttcagcgactaccagtggcttcacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccttcgggacgctccgtgatgttaacggttcagttcactctcggctggcctttgtacctag

SEQ ID NO: 19849 - DNA, 421 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtaaggtttcatttagcgcctcaaatagatcctgttcaggaaccggatcaaagagttcctccgcagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 19850 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19851 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtgatgttaacggttcagttcactctcgggtggcctgaatacttag

SEQ ID NO: 19852 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcaatggcgatggcaagcaggcgctggagacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19853 - DNA, 352 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19854 - DNA, 356 bp, Artificial
  Mutation in BnaC.FAD2.a introduced by TALE nuclease pair BnFAD2_T02
cctctcctccctcaccctctcccttacctcgcctggaccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaaccgtccatttcacgctcggctggcctttgtacttag

SEQ ID NO: 19855 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 19856 - DNA, 358 bp, Artificial
  Mutation in BnaC.FAD2.a introduced by TALE nuclease pair BnFAD2_T02
cctctcctccctcaccctttatcctacttcgcctggcctctctaatgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagttcctcaacaaccctttgggacgcaccgttatgttaacggttcatttctctctctgcttgccgttgtacttag

SEQ ID NO: 19857 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgttcccaagaagaagtcagacatcaagtggtacggcaagtacctcaacaaccctttgggacgcaccgtgatgttaacggttcagttcactctcggcttgcctttgtacttag

SEQ ID NO: 19858 - DNA, 392 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagactgagcctttcgttttatctgttgtttgtcggtgaacgctcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19859 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 19860 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcggctaccagtggcttgacgacaccgtcggtctcatcttccactccttcctcctcgtcccttacttctcctggaagtacatcgacgccaccattccaacactggctccctcgagagagacgaagtgcttgtccccaagaagaagtcagacatcaagtggtacggcaagtacctaaacaaccctttgggacgcaccgtgatgttaacggttcagttcactctcggctggccgttgtacttag

SEQ ID NO: 19861 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctgtgtacttag

SEQ ID NO: 19862 - DNA, 332 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 19863 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaacaagaagtccgccatcaactggtccggcaagtacctctccaaccctttgggaccccccgtgatgttaacggttcaggtcactctcggctggccttagtacttag

SEQ ID NO: 19864 - DNA, 309 bp, Artificial
  Mutation in BnaC.FAD2.a introduced by TALE nuclease pair BnFAD2_T02
cctctcctccctcaccctctctcctacttcgcctggcctctctactgggcctgccatggctgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtattag

SEQ ID NO: 19865 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 19866 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtctccaagaagaagtcagacatcaagtggtacggcaagtacctcaacaaccctttgggacgcaccgtgatgttaacggttcagttcactctcggctggcctttgtacttag

SEQ ID NO: 19867 - DNA, 392 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtgcattgcgcttaccagaggaaaactagaaactcatcgacgccaccattccaacactggcttcctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 19868 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgcgcggctggcctttgtacttag

SEQ ID NO: 19869 - DNA, 355 bp, Artificial
  Mutation in BnaC.FAD2.a introduced by TALE nuclease pair BnFAD2_T02
cctctcctccccaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19870 - DNA, 401 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagaatgattttattttgactgatagtgacctgttcgttgcaacaaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19871 - DNA, 433 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcggcgagcggtatcagctcactcaaaggcggtaatacggttatccacagaatcaggggataacgcaggaaagaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19872 - DNA, 392 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggcctggcacagcaccggcaagcaggcgctggagtcatcgacgccaccattccaacactgactccctcgagagagacgaagtgtttgtccccaagaagaagtcagacatcaagtggtacggcaagtacctcaacaaccctttgggacgcactgtgatgttaacggttcagttcactctcggctggcctttgtacttag

SEQ ID NO: 19873 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19874 - DNA, 346 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19875 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19876 - DNA, 357 bp, Artificial
  Mutation in BnaC.FAD2.a introduced by TALE nuclease pair BnFAD2_T02
cctctcctccctcaccctctctcctacttcgcctggcctctctactgggcctcccaagggtgcgtcctaaccggcgtctgggtcatagcccacgagtgcggccaccacgccttcagcgactaccagtggcttgacgacaccgtcggtctcatattccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggccattgtacgtag

SEQ ID NO: 19877 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19878 - DNA, 355 bp, Artificial
  Mutation in BnaC.FAD2.a introduced by TALE nuclease pair BnFAD2_T02
cctctcatccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtaccccaacaaccctttgggacgcaccgtgatgttaacggttcagttcactctcggctggccttcgtactta

SEQ ID NO: 19879 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcccctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19880 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 19881 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 19882 - DNA, 311 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgtctttgtccccaagaagaagtcagacatcaagtggtacggaaagtacctcaacaaccctttgggacgcaccgtgatgttaacggttcagttcactctcggctggcctttgtacttag

SEQ ID NO: 19883 - DNA, 352 bp, Artificial
  Mutation in BnaC.FAD2.a introduced by TALE nuclease pair BnFAD2_T02
cctctcctccctcaccctctctcctacttctcctggcctctctactgggcctcccatctctgcgtcctaaccggcgtctgggtcatagcccacgagtgcgtccaccacgccttcagcgactaccagtggcttgacgacaccgtcggtctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19884 - DNA, 359 bp, Artificial
  Mutation in BnaC.FAD2.a introduced by TALE nuclease pair BnFAD2_T02
cctctcctccctcaccctctctcctacttcgcctagactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttggtacgcaccgtgatgttaacggttcatttcactcgcggctggcctttgtacttag

SEQ ID NO: 19885 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcaatggcgatggcaagcaggcgctggagacggtcatcgacgccaccattccaacactggctccctcgagagagacgaagtggttgtccccaagaagaagtcagacatcaagtggtacgacaagtacctcaacaacccgttgggacgccccgtgatgttaacggttcatttcactcgcggctggccattgtacttag

SEQ ID NO: 19886 - DNA, 357 bp, Artificial
  Mutation in BnaC.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccacaagaagaagtcagacatcaagtggtacggcaagtacctcaacaaccctttgggacgcaccgtgatgttaacggttcagttcactctcggcgggcctttgtacttag

SEQ ID NO: 19887 - DNA, 362 bp, Artificial
  Mutation in BnaC.FAD2.a introduced by TALE nuclease pair BnFAD2_T02
cctctcctccctcaccctctctcctacttcgcctggcctctcttctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacaccaagtggtacggcaagtacctcaacaaccccttgggacgcaccgtgaggttaacggtgcagttcactctcggctggccttggtccttag

SEQ ID NO: 19888 - DNA, 360 bp, Artificial
  Mutation in BnaC.FAD2.a introduced by TALE nuclease pair BnFAD2_T02
cctctcctccctcaccctgtctcctacttcgcctggactctctactgggcctgccaagggtgcgtcctaaccggcgactgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacgacaagtacctcaacgacctgttgggacgcgccgtgtttttatcggttcatttccctctcggttggccttagtacttag

SEQ ID NO: 19889 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 19890 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19891 - DNA, 395 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagccgccggagtaggccttggtgtccacgatcacgccgtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19892 - DNA, 358 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcagcgtcccttggggacgcaccgtggtgttaacggtttatgtcactctccgctggccttagtacttag

SEQ ID NO: 19893 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggccttggtacttag

SEQ ID NO: 19894 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 19895 - DNA, 319 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaaggagacagacatcgagtggtacggcaagtacctcaacaccctgttgggccgcaccgggatgttaatggtgcaggtcacttgtgggtggccattgtacgtag

SEQ ID NO: 19896 - DNA, 356 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcaaacatcaagtggtacggcaagtacctcaacaacccgctaggacgcacggtgatgctaaccgtccagttcacgctcggctggcctttgtacttag

SEQ ID NO: 19897 - DNA, 357 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcacgctcggctggcctttgtacttag

SEQ ID NO: 19898 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 19899 - DNA, 356 bp, Artificial
  Mutation in BnaC.FAD2.a introduced by TALE nuclease pair BnFAD2_T02
cctctcctccctcaccctctcccctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 19900 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19901 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccataaaacaaagttaaacattgggcttcctggagccgcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19902 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacacgggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19903 - DNA, 319 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaaccgctaggacgcacggtgatgctaaccgtccagttcacgctcggctggcctttgtacttag

SEQ ID NO: 19904 - DNA, 360 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19905 - DNA, 347 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacgacaagtacctcaacaaccctttgggacgcaccgtgatgttaacggttcagttcacgctcggctggcctttgtacttag

SEQ ID NO: 19906 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactttg

SEQ ID NO: 19907 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 19908 - DNA, 363 bp, Artificial
  Mutation in BnaC.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19909 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19910 - DNA, 362 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtcacatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacagccctttgggacgcaccgtgatgttaaccgttcagttcactctcggctggcctttgtacttag

SEQ ID NO: 19911 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgactacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgccccgtgatgttaacggttcagttcactcgcggctggcctttgtacttag

SEQ ID NO: 19912 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19913 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19914 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcacgctcggctggcctttgtacttag

SEQ ID NO: 19915 - DNA, 355 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggccttggtacttag

SEQ ID NO: 19916 - DNA, 355 bp, Artificial
  Mutation in BnaC.FAD2.a introduced by TALE nuclease pair BnFAD2_T02
cctctcctccctcaccctctcccttaccccgcctggcccctctactgggcctgccaagggtgcgtcctaaccggcgtctgggtcatagcccacgagtgcggccaccacgccgtcagcgactaccagtggcttgacgacaccgtcggtctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19917 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 19918 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagtccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19919 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcataccccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19920 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtcttggtcatagcccacgagtgcggccaccacgccttcagcgactaccagtggcttgacgacaccgtcggtctcatcttccactccttcctcctcgtcccttacttctcctggaagtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19921 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19922 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 19923 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacaccggatccctcgagagggttgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19924 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttaagcgactaccagtggcttgacgacaccgtcggtctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19925 - DNA, 363 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctccgctggcctttgtacttag

SEQ ID NO: 19926 - DNA, 311 bp, Artificial
  Mutation in BnaC.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgttcgtccccaagaagaaatccgacatcaagtggtacggaaagtacctcaacaacccgctatgacgcacggtgatgctaaccgtccagttcacgctcggctggcctttgtacttag

SEQ ID NO: 19927 - DNA, 397 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatgcccgaggcatagactgtaccccaaaaaaacagtcataagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19928 - DNA, 291 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19929 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgttcagttcactctcggctggcctttgtacttag

SEQ ID NO: 19930 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19931 - DNA, 357 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatcgcccacgaatgcggccaccacgccttcagcgaccaccagtggcttgacgacaccgtcggtcttatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19932 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacctag

SEQ ID NO: 19933 - DNA, 356 bp, Artificial
  Mutation in BnaC.FAD2.a introduced by TALE nuclease pair BnFAD2_T02
cctctcctccctcaccctctctcctacttcgcctggcccctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcgccgtgatgttagcggttcagttcactctcggctggcctttgtacttag

SEQ ID NO: 19934 - DNA, 329 bp, Artificial
  Mutation in BnaC.FAD2.a introduced by TALE nuclease pair BnFAD2_T02
cctctcctccctcaccctctctcctacttcgcctggcctctatactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19935 - DNA, 444 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaagccgtgggcctggcacagcaccggcaacagccgctggaccgtctccagagaagtaatctgctgtttgcaaacaaaaaaaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19936 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 19937 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtttcatcttccactccttcctcctcgtcccttacttctcctgggagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagtgcactcgcggcgggccgttgtacttag

SEQ ID NO: 19938 - DNA, 311 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttaacgataccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 19939 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacacagtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19940 - DNA, 332 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgttaacggttcagttcacgctcggctggccgttgtacttag

SEQ ID NO: 19941 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggttccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 19942 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcaaacatcaagtggtacggaaagtacctcaacaacccgctaggacgcacggtgatgctaaccgtccatttcactctcggctggcctttgtacttag

SEQ ID NO: 19943 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaaccctttgggacgcaccgtgatgttaacggttcagttcactctcggctggcctttgtacttag

SEQ ID NO: 19944 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggagcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19945 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcaactaccagtggcttgacgacaccgtcggtctcatcttccactccttcctcctcgtaccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19946 - DNA, 353 bp, Artificial
  Mutation in BnaC.FAD2.a introduced by TALE nuclease pair BnFAD2_T02
ctcctccctcaccctctctcatacttcgtctggcgtctctactgcgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 19947 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 19948 - DNA, 357 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19949 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19950 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19951 - DNA, 348 bp, Artificial
  Mutation in BnaC.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19952 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctgtcatcgacgccaccattccaacactggctccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 19953 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacacccctttgggacgcaccgtgatgttaacggttcatttcactctcggctggcctttgtacttag

SEQ ID NO: 19954 - DNA, 365 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaactacagtcatcgacgccaccattccaacactggctccctcgagagagacgaagtgtttgtccccaagaagaagtcagacatcaagtggtacggcatgtacctcaacaaccctttgggacgcaccgtggtgttaacggttcagttcactcgcggctggcctttgtacttag

SEQ ID NO: 19955 - DNA, 347 bp, Artificial
  Mutation in BnaC.FAD2.a introduced by TALE nuclease pair BnFAD2_T02
ccctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19956 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggccgttgtacttag

SEQ ID NO: 19957 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggagcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19958 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19959 - DNA, 396 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcaatttgttgcaacgaacaggtcactatcagtcaaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19960 - DNA, 404 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatctccagcgcctgcttgccaccgccattgctggcgatggccaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19961 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgccctaaccggcgtctgggtcatagcccacgagtgcggccaccacgccttcagcgactaccagtggcttcaccacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19962 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19963 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19964 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccgttgtacttag

SEQ ID NO: 19965 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttactcctcgtcccttacttctcctcatcgtcgccaccattccaacactggctccctcgagtgagtcgcagtgtttgtccccaagaagaactcagacatccggtgttacggcaagtccctctacaaccctttgggacgcaccgtgatgttaacggttcagttcactctcggctggccttttacttag

SEQ ID NO: 19966 - DNA, 326 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19967 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttaacgacaccgtcggtctcatcgacgcaaccattccaacactggctccctcgagagagacgaagtgtttgtccccaagaagaagtcagacatcaagtggtacggcaagtacctcaacaaccctttggcacgcaccgtgatgttaacggttcagttcacgctcggctggcctttgtacttag

SEQ ID NO: 19968 - DNA, 292 bp, Artificial
  Mutation in BnaC.FAD2.a introduced by TALE nuclease pair BnFAD2_T02
cctctcctccctcaccctttctcctacttcgcctggcctctctactgggcctgccaagggtgcgtcctaaccggcgtctgggtcatagcccacgagtgcggccaccacgccttcagcgactaccagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19969 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgctgctggcctttgtacttag

SEQ ID NO: 19970 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagctactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19971 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 19972 - DNA, 354 bp, Artificial
  Mutation in BnaC.FAD2.a introduced by TALE nuclease pair BnFAD2_T02
cctcttctccctcaccctctctcctacttcgcctggcctctctactgggcctgccaagggtgcgtcctaaccggcgtctgggtcatagcccacgagtgcggccaccacgccttcagcgactaccagtcgcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacatccctttggaacgcaccgtggtgttaacggttcagttcactctcggctggcctttgtacttag

SEQ ID NO: 19973 - DNA, 357 bp, Artificial
  Mutation in BnaC.FAD2.a introduced by TALE nuclease pair BnFAD2_T02
cctctcctccctcaccctctctcctacttcgcctggcctctatactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 19974 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 19975 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgtttgtccccaagaagaagtcagacatcaagtggtacggcaagtacctcaacatcccttggggacgcaccgtggtgtgaaccgttcagttcactctcggctggcctttgtacttag

SEQ ID NO: 19976 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactgtctccctcgagagagacgaagtgtttgtccccaagaagaagtcagacatcgagtggtacggcaagtacctcaacaaccctttgggacgcaccgggatgttaacggttcagttcactcgcggctggcatttgtacgtag

SEQ ID NO: 19977 - DNA, 357 bp, Artificial
  Mutation in BnaC.FAD2.a introduced by TALE nuclease pair BnFAD2_T02
cctctcctccctcaccctctctcctacttcgcctgccctctctactgggcctgccaagggtgcgtcctaaccggcgtctgggtcatagcccacgagtgtggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 19978 - DNA, 413 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggcacagcaccggcaacagcgcctgcaccgtctccagcgcctgcttgccaccaatatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19979 - DNA, 443 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaggcgatggccaccacctgctccggggtcaagccgtgggcctggcacagcaccggcaacagcgcctgcaccgtctccagcgcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19980 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 19981 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgttgttaacggttcagttcactctcggctggcctttgtacttag

SEQ ID NO: 19982 - DNA, 443 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgcaatgcactgacgggtgccccgctcaacttgacccctctccagcgcctgcttgccgccatcgtggctggcgatggccaccaccagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19983 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19984 - DNA, 322 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19985 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19986 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19987 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19988 - DNA, 354 bp, Artificial
  Mutation in BnaC.FAD2.a introduced by TALE nuclease pair BnFAD2_T02
cctctcctccctcaccctctctcctacttcgcctggcctctctactcggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccattgggacgcaccgtgatggtaacggttcaggtcactcttggctggcctttttacttag

SEQ ID NO: 19989 - DNA, 365 bp, Artificial
  Mutation in BnaC.FAD2.a introduced by TALE nuclease pair BnFAD2_T02
cctctcctccctcaccctgtgtcctacttcgcctggcctctctcctgagcctgccaaggacgcgtcctaaccggcgtctgggtcatagcccacgagtgcggccaccacgccttcagcgactaccagtggcttgacgacaccgtcggtctcctcttccactccttcctcctcgtcccttacttctcctggaagtacaaacagtcatcgacgccaccattccaaccctggctccctcgggagagacgaggggttcgtccccaagaagaagccagacatcacgtcgtacggcaggtaccccaacaaccttttgggccgccccgtgggtttaaaggtgcaagtgactcctggacgcccttagtacttag

SEQ ID NO: 19990 - DNA, 357 bp, Artificial
  Mutation in BnaC.FAD2.a introduced by TALE nuclease pair BnFAD2_T02
cctctctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19991 - DNA, 358 bp, Artificial
  Mutation in BnaC.FAD2.a introduced by TALE nuclease pair BnFAD2_T02
cctctcctccctcaccctctctcctacttcgcctagccactctactgggcctgccaagggtgcgtcctaaccggagtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccggtgggatgcacggtgatgttaaccgttcagttcactctcggctggcctttgtacttag

SEQ ID NO: 19992 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcagcatccctttgggacgcaccgtgatgttaacggtgaagttcactcttggctggccgttgtacgtag

SEQ ID NO: 19993 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtaattag

SEQ ID NO: 19994 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaactgttcagttcactctcggctggccttagtacttag

SEQ ID NO: 19995 - DNA, 357 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccattacttctcctggaaggtcatcgacgccaccattccaacactggctccctcgagagagacgaagtgtttgtccccaagaagaagtcagacatcaagtggtacggcaagtacctcaacaaccctttgggacgcaccttgatgttaacggttcagttcactctctgctggccgttggacttag

SEQ ID NO: 19996 - DNA, 352 bp, Artificial
  Mutation in BnaC.FAD2.a introduced by TALE nuclease pair BnFAD2_T02
cctctcctccctcaccctttctactacttcgcctggcctctctactgggcctgacaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctagtacgcacggtgatgctaaccgtccaggtcactcgcggctggcctgtgtacttag

SEQ ID NO: 19997 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacgtctccagcggctgttgccggtgctgtgccaggcccacggcttgaccccggagcaggtggtggccatcgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19998 - DNA, 346 bp, Artificial
  Mutation in BnaC.FAD2.a introduced by TALE nuclease pair BnFAD2_T02
cctctcctccctcaccctctctcctacttcgcctggcctctctactcggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagttgtacggcaagtacctcaacaaccctttgggacgctccgtgatattaacggttcagttcactctcggctggcgttgtacttag

SEQ ID NO: 19999 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacgaccctttgggacgcaccgtgatgttaacggttcagttcactctcggctggcctttgtacttag

SEQ ID NO: 20000 - DNA, 357 bp, Artificial
  Mutation in BnaC.FAD2.a introduced by TALE nuclease pair BnFAD2_T02
cctctcctccctcaccctctctcctacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20001 - DNA, 343 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctagcctttgtacttag

SEQ ID NO: 20002 - DNA, 355 bp, Artificial
  Mutation in BnaC.FAD2.a introduced by TALE nuclease pair BnFAD2_T02
cctctcctccctcaccctgtctcctacttcgcctggcctctctactgcgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcgtctggccgttgtacttag

SEQ ID NO: 20003 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccgacgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20004 - DNA, 406 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtactccagcgcctgcttgccaccattattgctggcgatggccaccacctgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20005 - DNA, 406 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtactccagcgcctgcttgccaccattattgctggcgatggccaccacctgtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20006 - DNA, 358 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaaatcagacatcaagtggttcggcaagtacctcaacaacccgctaggacgcacggtgatgctaaccggccagttcacgctcggctggcctttgtacttag

SEQ ID NO: 20007 - DNA, 332 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagttcctcaacaaccctttgggacgcactgtgatgttaacggttcagttcactctcggctggcctttggacttag

SEQ ID NO: 20008 - DNA, 356 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtctgacatcaagtggtacggcaagtacctcaacaaccctttgggacgcaccgtgatgctaaccgtccagttcacgctcggctggcctttgtacttag

SEQ ID NO: 20009 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaatcgacgccaccattccaacactcgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20010 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagtccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20011 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggctaccacgccttcagcgactaccggtggcttgacgacaccgtctgtctcatcttccactccttcctccacgtcccttacttctcctgatatcatcgacgccaccattccaacactggctccctcgaaagagacgaattgtttgtccccacgaactagtcaaacatcaattggtacggcaaatgcctcaacaaccctttggaactcaccgttattttaactgtgcagtgcactcgcggctgccctttatacttag

SEQ ID NO: 20012 - DNA, 354 bp, Artificial
  Mutation in BnaC.FAD2.a introduced by TALE nuclease pair BnFAD2_T02
cctctcctccctcaccctctctactacttcgcctgccctctctactgagcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacatccctttggtacgcaccgtgatgttaacggttcagttcactctcggctggcctttgtacttag

SEQ ID NO: 20013 - DNA, 443 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtgcaatgcactgacgggtgccccgctcaacttgacccctctccagcgcctgcttgccgccatcgtggctggcgatggccaccaccagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20014 - DNA, 358 bp, Artificial
  Mutation in BnaC.FAD2.a introduced by TALE nuclease pair BnFAD2_T02
cctctcctccctcaccctctcacttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20015 - DNA, 399 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagccgaagtttccaaaaggtcgttgatcaaagctcgccgcgttcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 20016 - DNA, 355 bp, Artificial
  Mutation in BnaC.FAD2.a introduced by TALE nuclease pair BnFAD2_T02
cctctcctccctcaccctctcccctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagcatcgacgccaccattccaacactggctccctcgagagagacggagtgtttgtccccaagaagaagtcagacatcaagtggtacggcaagtacctcaacaaccctttgggacgcaccgtgatgttaacggttcagttcactctcggctggccgttgtacttag

SEQ ID NO: 20017 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20018 - DNA, 357 bp, Artificial
  Mutation in BnaC.FAD2.a introduced by TALE nuclease pair BnFAD2_T02
cctctcctccctcaccctctcccctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20019 - DNA, 379 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagccaacgagtgcggccaccacgccttcagcgactaccagtggcttgacgacaccgtcggtctcatcttccactccttcctcctcgtcccttacttctcctggctccgcccccctgacgagcatcacagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 20020 - DNA, 366 bp, Artificial
  Mutation in BnaC.FAD2.a introduced by TALE nuclease pair BnFAD2_T02
cctctcctccctcaccctctctcctacttcgcctggcctctctactgggtctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaatacagtcatcgacgccaccattccaacactggctccctcgagagagacgaagtgtttgtccccaagaagaagtcagacatcaagtggtacggcaagtacctctacaacccgttgggacgcaccgtgatgttaacggttcagttcactctcggctggcctttgtacttag

SEQ ID NO: 20021 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttacactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20022 - DNA, 309 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaaaaccctttgggacgcaccgtgatgttaacggttcggttcactctcggctggcctttgtacttag

SEQ ID NO: 20023 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcacacatcaagtggtacggcaagtacctcaacaaccctttgggacgcaccgtgatgttaacggttcagttcactctcggctggcctttgtacttag

SEQ ID NO: 20024 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttatccccaagaagaagtcagacatcaagtggtacggcaagtacctcaacaaccctttgggacgcaccgtgatgttaacggttcagttcactctcggctggcctttgtacttag

SEQ ID NO: 20025 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcaatggcgatggcaagcaggcgctggcgacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20026 - DNA, 437 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgtctccagcgcctgttgccggtgctgtgccaggcccacggcttgaccccggagcaggtggtggccatcgccatacagtcatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20027 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgtcaaccgttcagttctctctcggctggcctttgtacttag

SEQ ID NO: 20028 - DNA, 360 bp, Artificial
  Mutation in BnaC.FAD2.a introduced by TALE nuclease pair BnFAD2_T02
cctctcctccctcaccctctctactacttcgcctggcctctctactgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20029 - DNA, 357 bp, Artificial
  Mutation in BnaC.FAD2.a introduced by TALE nuclease pair BnFAD2_T02
cctctcctccctcaccctctctcctacttcgcctggcctctctactgcgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacacgggctccctcgagagagacgaagtgtttgtccccaagaagaagtcagacatcaagtggtacggcaagtacctcaacatccctttgggacgcaccgtgatgttaacggttcagttcacgctcggctggcctttgtacttag

SEQ ID NO: 20030 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 20031 - DNA, 354 bp, Artificial
  Mutation in BnaC.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20032 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaccccgttgggacgcaccgtgatgttaacggttcagttcactctcgtctggcctttggacttag

SEQ ID NO: 20033 - DNA, 344 bp, Artificial
  Mutation in BnaC.FAD2.a introduced by TALE nuclease pair BnFAD2_T02
cctctcctccctcaccctctctcctactccgtctggcctgcttcctgcgcctcccacgggtgcgtcctaacagccgtctgggtcatcgcccacgagtgcggccaccacgacttcagcgactaccaggggcttgacgacaccgtcgggctcatcttccactccttcctcctcgtcccttactcatcgacgccaccattccaacactggctccctcgagagagacgaagtgtttgtccccaagaagaagtcacacatcacgtggcacggaaagtaccttaacaccccgttgggacgaacgggaatgtaaccggttcagttcactctcggctggcctttgtacttag

SEQ ID NO: 20034 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20035 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20036 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 20037 - DNA, 363 bp, Artificial
  Mutation in BnaC.FAD2.a introduced by TALE nuclease pair BnFAD2_T02
cctctcctccctcaccctctccattacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20038 - DNA, 357 bp, Artificial
  Mutation in BnaC.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20039 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20040 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacgaccctttgggacgcaccgggaggttaacggttcagttcactctcggctggcttttgtacttag

SEQ ID NO: 20041 - DNA, 318 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20042 - DNA, 400 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtctccaaattgcagttcgcgcttagctggataacgccacggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20043 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatggtaacggttcagttcactctcggctggccgttgtacttag

SEQ ID NO: 20044 - DNA, 353 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20045 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttaggacgcaccgtgatgttaacggttcagttcactctcggctggcctttgtacttag

SEQ ID NO: 20046 - DNA, 358 bp, Artificial
  Mutation in BnaC.FAD2.a introduced by TALE nuclease pair BnFAD2_T02
cctctcctccctcaccctatctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgtgaacggttcagttcactctcggctggcccttgtacttag

SEQ ID NO: 20047 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20048 - DNA, 353 bp, Artificial
  Mutation in BnaC.FAD2.a introduced by TALE nuclease pair BnFAD2_T02
cctctcctccctcaccctctctcctacttcttctggcttcctttctgtgatacccatctgcgagcccacaacaccgtctgggtcatagcctaccagcgcggccaccacgccttcagcgactaccagtggcttgacgacaccgtcggtctcatcttccactccttcctcctcgtcccttacttctcctggaaatcgacgccaccattccaacactggctccctcgagagagacgaagtgtttgtccccaagaagaagtcagacagcaagtggtacggcaggtacctcaacgaccctgagggacacaccagaaagttaacggttcagttcactctcggctggcctttgtacttag

SEQ ID NO: 20049 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20050 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 20051 - DNA, 357 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaaatacgacatcaagtggtacggaaagtacctcaacaacccgctaggacgcacggtgatgctaaccgtccagttcacgctcggctggcctttgtacttag

SEQ ID NO: 20052 - DNA, 310 bp, Artificial
  Mutation in BnaC.FAD2.a introduced by TALE nuclease pair BnFAD2_T02
cctctcctccctcaccctctctcctacttcgcctggcctctctactggacctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20053 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtatcatcttccactccttcctcctcgtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctgtgtacttag

SEQ ID NO: 20054 - DNA, 351 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaatactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20055 - DNA, 359 bp, Artificial
  Mutation in BnaC.FAD2.a introduced by TALE nuclease pair BnFAD2_T02
cctctctccctcaccctctctcctacttcgcctggcctctctactgggcctgccaagggtgcgtcctaaccggcgtctgggtcatagcccacgagtgcggccaccacgccttcagcgactaccagtggcttgacgaccccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20056 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaagtagccatcgacgccaccattccaacaccggatccatcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 20057 - DNA, 360 bp, Artificial
  Mutation in BnaC.FAD2.a introduced by TALE nuclease pair BnFAD2_T02
cctctcctccctcaccctctctactacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 20058 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20059 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctgtgggacgcaccgtgatggtaacggttcagttcactctcggctggcctttgtacttag

SEQ ID NO: 20060 - DNA, 354 bp, Artificial
  Mutation in BnaC.FAD2.a introduced by TALE nuclease pair BnFAD2_T02
cctctgctccctcaccctctctcctacttcgcctggcctctctactgcgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagggatgaagtgttcgtccccaagaagaagtcagacatcaagtggtacggcaagtacctcaacaaccctttgggacgcaccgtgatgtcaagggttcagtgcagtctcccctggcctgtgtacttag

SEQ ID NO: 20061 - DNA, 356 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20062 - DNA, 344 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttactcatcgacgccaccattccaaaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20063 - DNA, 443 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgcaatgcactgacgggtgccccgctcaacttgacccctctccagcgcctgcttgccgccatcgtggctggcgatggccaccaccagtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 20064 - DNA, 396 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccccacggcttgaccccccagcaggaggtggccatcgccattctccagtcatcgacgccaccattccaacactagctccctcgagagagacgaagtgtttgtccccaagaagaagtcagacatcaagtggtacggcaagtacctcaacaaccctttgggacgcaccgtgatgttaacggttcaggtcactctcggctggcctttggacttag

SEQ ID NO: 20065 - DNA, 310 bp, Artificial
  Mutation in BnaC.FAD2.a introduced by TALE nuclease pair BnFAD2_T02
cctctcctccctcactctctctcctacttcgcctggcctctctactgggcctgccaagggtgcgtcctaaccggcgtctgggtcatagcccacgagtgcggccaccacgccttcagcgactaccagtggcttgacgacaccgtcggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20066 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctgtgtacttag

SEQ ID NO: 20067 - DNA, 331 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttggcgacaccgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 20068 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20069 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20070 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccatcagcgactaccagtggcttgacgacaccgtaggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 20071 - DNA, 354 bp, Artificial
  Mutation in BnaC.FAD2.a introduced by TALE nuclease pair BnFAD2_T02
cctcttctccctcaccctgtctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacagccctgtgggacgcaccgtgatgttaacggttcagttcactctaggcgggccgttgtacttag

SEQ ID NO: 20072 - DNA, 356 bp, Artificial
  Mutation in BnaC.FAD2.a introduced by TALE nuclease pair BnFAD2_T02
cctctcctccctcaccatctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacaccggatccctcgagagggatgaagtgttcgtccccaagaagaaatccgacatcaagtggtacggaaagtacctcaacaacccgctaggacgcacggtgacgctaaccgcccagttcacgctcggctggcctttgtacttag

SEQ ID NO: 20073 - DNA, 434 bp, Artificial
  Mutation in BnaC.FAD2.a introduced by TALE nuclease pair BnFAD2_T02
cctctcctccctcaccctctctcctacttcgcctgtcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatggcggcaagcaggcgctggagacggtccagcggctgttgccggggctgtgccaggcccacggcttgaccccccagtcagcgacgccaccattccaacactggctccctcgagagagacgaagtgtttgtccccaagaagaagtcagacatcaagtggtacggcaagtacctcaacacccctttggcacgcaccgtgatgtaaacggttcagttcactctcggctggcctttgtacttag

SEQ ID NO: 20074 - DNA, 427 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctccagcgcctgcttgccaccattattgctggcgatggccaccacctgctggggggtcaagccgtgggcctggcacagcaccggacgccaccattccgacactggctccctcgagagagacgaagtgtttgtccccaagaagaagtcagacatcaagtggtacgacaagtacctcaacaaccctttgggacgcaccgtgatgttaacggttcagttcacgctcggctggcctttgtacttag

SEQ ID NO: 20075 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcggcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20076 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 20077 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20078 - DNA, 347 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcataacgggcctctgggtcatcgcccacgaatgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20079 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20080 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtcttag

SEQ ID NO: 20081 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 20082 - DNA, 392 bp, Artificial
  Mutation in BnaC.FAD2.a introduced by TALE nuclease pair BnFAD2_T02
cctctcctccctcaccctctctcctacttcgcatggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggcctggcacagcaccggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacactcggctggcctttgtacttag

SEQ ID NO: 20083 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 20084 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20085 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20086 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaacccttttggacgcaccgtgatgttaaccgttcagttcactctcggctggcctttgtacttag

SEQ ID NO: 20087 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20088 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcctacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20089 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcgagtggtacggcaagtacctcaacaaccctttggaacgccccgggatgttaacggttcagttcactctcggctggcctttgtacttag

SEQ ID NO: 20090 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20091 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacgtctccagcggctgttgccggtgctgggccaggcccacggcttgaccccggagcaggtggtggccatcgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20092 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggcttgcctttgtacttag

SEQ ID NO: 20093 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20094 - DNA, 362 bp, Artificial
  Mutation in BnaC.FAD2.a introduced by TALE nuclease pair BnFAD2_T02
cctctgctccctcaccctctcccttacctcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtccggcaagtgcctcaacaacccgttgggacgcaccgtgatgttaacgtttcagttcactcttcgctggcaattacacttag

SEQ ID NO: 20095 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 20096 - DNA, 397 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccagtggtggtttgtttgccggaaaaagagttggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20097 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 20098 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcagcaaccctttgggacgcaccgtgatgttaacggttcagttcactctcggctggcctttgtacttag

SEQ ID NO: 20099 - DNA, 358 bp, Artificial
  Mutation in BnaC.FAD2.a introduced by TALE nuclease pair BnFAD2_T02
cctctcctccctcaccctgtctcctacttcgcctggcctctctactgcgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20100 - DNA, 291 bp, Artificial
  Mutation in BnaC.FAD2.a introduced by TALE nuclease pair BnFAD2_T02
cctcttctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagtggtacggcaagtacctcaacaacccttttggacgcaccgtgatgttaacggttcagttcactctcggctggcctttgtacttag

SEQ ID NO: 20101 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaataagaagtcagacatcaagtggtacggcaattacctcaacgaccctgtgggacgcaccgtgaggttaaccgttcagttcactcttggcgggccgttgtacttag

SEQ ID NO: 20102 - DNA, 358 bp, Artificial
  Mutation in BnaC.FAD2.a introduced by TALE nuclease pair BnFAD2_T02
cctctcctcctcaccctctctcctacttcgcctggcctctctcctgggcctgccaagggtgcgtcctaaccggcgtctgggtcatagcccacgagtgcggccaccacgccttcagcgactaccagtggcttgacgacaacgtcggtctcatcttccactccttcctcctcgtcccttacttctcctggaagtagtcatcgacgccaccattccaacactggctccctcgagagagacgaagtgtttgtccccaagaagaagtcacacatcaagtggtacggcaactacctcagcaacccttcgagacgccccgtggtgttaaccgttcagttcactctcggctgccctttgtacttag

SEQ ID NO: 20103 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcacacatcaagtggtacggcaagtacctcaacaaccctttgggacgccccgtgaggttaaccgttcagttcacgctcggctggcctcagtacttag

SEQ ID NO: 20104 - DNA, 331 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 20105 - DNA, 357 bp, Artificial
  Mutation in BnaC.FAD2.a introduced by TALE nuclease pair BnFAD2_T02
cctctcctccctcaccctctctcctacttcgcctggcctctctactgggcctaccaagggtgcgtcctaaccggcgtctgggtcatagcccacgagtgcggccaccacgccttcagcgactaccagtggcttgacgacaccgtcggtctcatcttccactccttcctcctcgtcccttacttctcccggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20106 - DNA, 346 bp, Artificial
  Mutation in BnaC.FAD2.a introduced by TALE nuclease pair BnFAD2_T02
cctctcctccctcaccctctctcctacttcgcctggcctctctacggggcctgccaagggtgcgtcctaaccggcgtctgggtcatagcccacgagtgcggccaccacgccttcagcgactaccagtggcttgactacaccgtcggtctcatcttccactccttcctcctcgtcccttacttctcctggagccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20107 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20108 - DNA, 349 bp, Artificial
  Mutation in BnaC.FAD2.a introduced by TALE nuclease pair BnFAD2_T02
cctctcctccctcaccctctcacttacctcgcctggcccctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttaatcgtgtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 20109 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcaatggcggtggcaagcaggcgctggagacggtcatcgacgccaccattccaacactggctccctcgagagagacgaagtgtttgtccccaagaagaagtcagacatcaagtggtacgacaagtacctcaacagccctttgggacgcaccgtgatgttaacggttcagttcactctcggctggcctttgtacttag

SEQ ID NO: 20110 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20111 - DNA, 389 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacagcaacgtcggttcgagatggcgctcgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20112 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 20113 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 20114 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagtgtgcgtcctaaccggcgtctgggtcatagcccacgagtgcggccaccacgccttcagcgactaccagtggattgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20115 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 20116 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggttcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacagttcagttcactctcggctggccgttgtacttag

SEQ ID NO: 20117 - DNA, 356 bp, Artificial
  Mutation in BnaC.FAD2.a introduced by TALE nuclease pair BnFAD2_T02
cctctcctcactcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20118 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaacactttgggacgcaccgtgatgttaacggttcagttcactctcggctggcctttgtacttag

SEQ ID NO: 20119 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgctccgtgatggtaacggttcagttcacgctcggctggcctttgtacttag

SEQ ID NO: 20120 - DNA, 357 bp, Artificial
  Mutation in BnaC.FAD2.a introduced by TALE nuclease pair BnFAD2_T02
cctctcctccctcaccctctcccctacttcgcctggccccgctactgggcctcacaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacgaggatcctaaccgtccagctcacgctcggctggcctttgtacttag

SEQ ID NO: 20121 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtaattag

SEQ ID NO: 20122 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 20123 - DNA, 359 bp, Artificial
  Mutation in BnaC.FAD2.a introduced by TALE nuclease pair BnFAD2_T02
cctctctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 20124 - DNA, 342 bp, Artificial
  Mutation in BnaC.FAD2.a introduced by TALE nuclease pair BnFAD2_T02
cctctcctccctcaccctctctcctacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20125 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagggatgaagtgttcgtccccaagaagaaatccgacatcaagtggtacggaaagtacctcaacaacccgctaggacgcacggtgatgctaacggttcagttcactctcggctggcctttgtacttag

SEQ ID NO: 20126 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20127 - DNA, 361 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggctttgtacttag

SEQ ID NO: 20128 - DNA, 357 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtatctcaacaacccgctaggacgcacggtgatgctaaccgtccagttcactctcggctggcctgtgtacttag

SEQ ID NO: 20129 - DNA, 345 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20130 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20131 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 20132 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtctgtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcagcaaccctgtgggacgcaccgtgagtttaacggttcggttcacgctcggctggcctttgtacttag

SEQ ID NO: 20133 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaaggaatccaacatcgagtggtacggaaagtacctcaacaccccgctaggacgcacggtgatgctaaccgtccagttcacgctcggctggcctttgtacttag

SEQ ID NO: 20134 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaaatccgacatcaagtggtacggaaagtacctcaacaacccgctaggacgcacggtgatgttaacggttcagttcgctctcggctggcctttgtacttag

SEQ ID NO: 20135 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacaccggatccctcgagagggatgaagtgttcgtccccaagaagaagtcagacatcaagtggtacggaaagtacctcaacaaccctttgggacgcaccgtgatgttaacggttcagttcactctcggctggcctttgtacttag

SEQ ID NO: 20136 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaagggcgcgtcctaaccggcgtctgggtcatagcccacgagtgcggccaccacgccttcagcgactaccagtggcttgacgacaccgtcgtgctcatcttccactccttcctcctcgtcccttacttctcctggaagtatcgacgccaccattccaacactggctccctcgagagagacgaagtgtttgtccccaagaagaagtcagacatcaagtggtacggcaagtacctcagcagccctgtgggacgcaccgtgaggttaacggttcagttcactctcggctggcctttgtacttag

SEQ ID NO: 20137 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20138 - DNA, 330 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20139 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaaggacctcaacaacccgctaggacgcacggtgatgctaaccgtccagttcacgctcggctggcctttgtacttag

SEQ ID NO: 20140 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctgtcctttgtacttag

SEQ ID NO: 20141 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcaatggcgatggcaagcaggcgctggagacggtcatcgacgccaccattccaacactggctccctcgagagagacgaagtgttggtccccaagaagaagtcagacatcaagtggtacggcaagtacctcaacaaccctttgggacgcaccgtgatgttaacggttcagttcactctcggctggcctttgtacttag

SEQ ID NO: 20142 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaggcagacataaagtggtacggcaagtaccacaaaaaaccggtggaacgcaccgggatgttaacggtgaaggtcactcgcggctggcatgtgtacgtag

SEQ ID NO: 20143 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacaccggatccctcgagagggatgaagtgttcgtccccaagaagaaatccgacatcaagtggtacggaaagtacctcaacaaccctctaggacgcacggtgatgctaaccgtccagttcacgctcggctggcctttgtacttag

SEQ ID NO: 20144 - DNA, 356 bp, Artificial
  Mutation in BnaC.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20145 - DNA, 329 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20146 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 20147 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaaatccgacatcaagtggtacggaaagtacctcaacaaaccgctaggacgcacggtgatgctaaccgtccagttcacgctcggctggcctttgtacttag

SEQ ID NO: 20148 - DNA, 344 bp, Artificial
  Mutation in BnaC.FAD2.a introduced by TALE nuclease pair BnFAD2_T02
cctctcctccctcaccctctctcctacttcgcctggcctcactactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacagcaagtggtacggcaagtacctcaacaaccctttgggacgcaccgtgatgttaacggttcagttcactctcggctggcctttgtacttag

SEQ ID NO: 20149 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagccatcaagtggtacggcaagtacctcaacaaccctttgggacgcaccgtgatgttaacggttcagttcactctcggctggcctttgtacttag

SEQ ID NO: 20150 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtttcatcgacgccaccattccaacaccggatccctcgagagggatgaagtgttcgtccccaagaagaaatccgacatcaagtggtacggaaagtacctcaacagcccgctaggacgcacggtgatgctaaccgtccagttgacgcccggctggcctttgtacttag

SEQ ID NO: 20151 - DNA, 467 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggaaagcgggcagtgagcgcaacgcaattaagctcgccgcgttgtttcatcaagccttacggtcaccgtaaccagcaaatcaatatcactgtgtggcttcaggccgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20152 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacacccctttgggacgcaccgtgatgttaaccgttcagttcactctcggctggcctttgtacttag

SEQ ID NO: 20153 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 20154 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 20155 - DNA, 364 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcataggccacgagtgcggccaccacgccttcagcgactaccagtggcttgacgacaccgtcggtctcatcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagtgcactctcgtctcgccgttgtacttag

SEQ ID NO: 20156 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtgacttgacgacaccgtcggtctcatcttccactccttcctcctcgtcccttacttctcctggaagcgacgccaccattccgacactggctccctcgagagagacgaagtgtttgtccccaagaagaagtcagacatcaagtggtacggcaagtacctcaacagccctgtgggacgcaccgggatgttaacggttcagttcactctcggctggcctttgtacttag

SEQ ID NO: 20157 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagccatcaagtggtacggcaagtacctcaacagccctgtgggacgcagagagatgtcaacggttcagtgcagcctcggctgccctttgtacttag

SEQ ID NO: 20158 - DNA, 363 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20159 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaccccgctaggacgcacggtgatgctaaccgtccagttcacgctcggctggcctttgtacttag

SEQ ID NO: 20160 - DNA, 356 bp, Artificial
  Mutation in BnaC.FAD2.a introduced by TALE nuclease pair BnFAD2_T02
cctctcctccctcaccctctctcctacttcgcctcgcctctctactgggcctgccaagggtgcgtcctaaccggcgtctgggtcatagcccacgagtgcggccaccacgccttcagcgaccaccagtggctggacgccaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacatccctttgggacgcaccgtgatgttaaccgttcagttcactctcggctggcctgagtacttag

SEQ ID NO: 20161 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactcctttctcctcgtcccttactcctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20162 - DNA, 379 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggtcgttcggctgcggcgagcggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20163 - DNA, 348 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20164 - DNA, 345 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccgacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20165 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20166 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20167 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccaccattccaacaccggatccctcgatagggacgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 20168 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 20169 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaactggcctctgggtcatagcccacgcgtgcggccaccacgccttcagcgactaccagtggcttgacgacaccgtcggtctcaccttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 20170 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacacaggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20171 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgtggccaccacgccttcagcgactaccagtggcttgacgacaccgtcggtctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20172 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20173 - DNA, 366 bp, Artificial
  Mutation in BnaC.FAD2.a introduced by TALE nuclease pair BnFAD2_T02
cctctcctccctcaccctctctcctacttctcctggcctctctactgggcctgccaagggtgcgtcctaacctccgtctgggtcatagcccacgagtgcggccatcacgccttcagcgactaccagtggcttgacgacaccgtcggtctcatcttccactccttcctcctcgtcccttacttctcctggaagtacaatacagtcatcgacgccaccattccaacactggctccctcgagagagacgaagtgtttgtccccaagaagaagtcagacatcaagtggtacggcaagtacctcaacaacgcgttgggacgcgccgtgagggtaacggttcagttcacgctcggctggcatttgtacttag

SEQ ID NO: 20174 - DNA, 312 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20175 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaacccttggggacgcaccgtgatgttaacgggtcagttcactcgcggctggcctgtgtacttag

SEQ ID NO: 20176 - DNA, 310 bp, Artificial
  Mutation in BnaC.FAD2.a introduced by TALE nuclease pair BnFAD2_T02
cctctcctccctcaccctctcccttacctcgcctggcccctctactgtgcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20177 - DNA, 310 bp, Artificial
  Mutation in BnaC.FAD2.a introduced by TALE nuclease pair BnFAD2_T02
cctctcctccctcaccctctcccttacctcgcctggctcctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20178 - DNA, 291 bp, Artificial
  Mutation in BnaC.FAD2.a introduced by TALE nuclease pair BnFAD2_T02
cctctcctccctcaccctctctcctacttcgcctggcttctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaaccgttcagttcacgctcggctggcctttgtacttag

SEQ ID NO: 20179 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactaccagtcatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 20180 - DNA, 341 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 20181 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20182 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcaatggcggaggcaagcaggcgctggagacggtcatcgacgccaccattccaacactggctccctcgagagagacgaagtgtttgtccccaagaagaagtcagacatcaagtggtacggcaagtacctcaacaaccctttgggacgcaccgtgatgtcaacggttcagttcactctcggctggcctgtgtacttag

SEQ ID NO: 20183 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgagtcatagcccacgagtgcggccaccacgccttcagcgactaccagtggcttgacgacgccgtcggtctcatcttccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20184 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccagcattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20185 - DNA, 330 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcgccaccattccaacactggctccctcgagagagacgaagtgtttgtccccaagaagaagtcagacatcaagtggtacggcaagtacatcaacaaccctttgggacgcaccgtgatgttaacggttcagttcactctcggctggcctttgtacttag

SEQ ID NO: 20186 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaggtgtttgtccccaagaagaaagccgacatcaagtggtacggaaagtacctcaacaacccgctaggacgcacggtgatgctaaccgtccagttcacgctcggctggcctttgtacttag

SEQ ID NO: 20187 - DNA, 360 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggccttggtacttag

SEQ ID NO: 20188 - DNA, 355 bp, Artificial
  Mutation in BnaC.FAD2.a introduced by TALE nuclease pair BnFAD2_T02
cctctcctccctcaccctctctcctacttcgcctggcctctctactcggcctgccaagggtgcgtcctaaccggcgtctgggtcatcgcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcacacatcaagtggtacggcaagtacctcaacacccctgtggtgcgcacggggatgtcaaccgttcagttcacgctcggctggcctttgtacttag

SEQ ID NO: 20189 - DNA, 392 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtacgtgcattgcgcttaccagaggaaaactagaaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20190 - DNA, 419 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacattccgtggcgttatccagctaagcgcgaactgcaatttggagaatggcagcgcaatgacacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20191 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20192 - DNA, 246 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgcaccgtgatgttaaccggtcagttctctctcggctggcctttgtacttag

SEQ ID NO: 20193 - DNA, 319 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 20194 - DNA, 357 bp, Artificial
  Mutation in BnaC.FAD2.a introduced by TALE nuclease pair BnFAD2_T02
cctctcctccctcaccctctcccttacctcgcctggtccctctactgggcctgccaaggctgcgtcctaacgggcctctgggtcatcgcccacgaatgcggccaccacgccttcagcgaccaccagtggcttgacgacaccgtcggtctcatcttccactccttcctccacgtcccttacttctcctggaaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 20195 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccatcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20196 - DNA, 353 bp, Artificial
  Mutation in BnaC.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccccttgggtcgcaccgtgatgttaacggttcagttcactctcgggtgcccagtgtacttag

SEQ ID NO: 20197 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 20198 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgctgccaccacgccttcagcgactaccagtggcttgacgacaccgtcggtcttatcttccactccttgctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20199 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20200 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20201 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgaggccaccacgccttcagcgactaccagtggcttgacgacaccgtcgggctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggccttagtacttag

SEQ ID NO: 20202 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtcatcgacgccaccactccaacactggccccctcgagagagacgaagtgtttgtccccaagaagaagtcagacatcaagtggtacggaaagtacctcaacaaccctttgggacgcaccgtgatgttaacggttcagttcacactcggctggcctttgtacttag

SEQ ID NO: 20203 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 20204 - DNA, 357 bp, Artificial
  Mutation in BnaC.FAD2.a introduced by TALE nuclease pair BnFAD2_T02
cctctcctccctcaccctctctcctacttcgcctggcatccctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 20205 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactcctttctcctcgtcccttactcctcctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20206 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacatccctttgggacgcaccgtgatgtaaacggttcagttcactctcggctggcctttgtacttag

SEQ ID NO: 20207 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 20208 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 20209 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaacccttgggacgcaccgtgatgttaacggttcagttcactctcggctggcctttgtacttag

SEQ ID NO: 20210 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtatggcaagtacctcaacaaccctttgggacgcaccgtgatgttaacggttcagttcactctcggctggcctttgtacttag

SEQ ID NO: 20211 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggctggcctttttacttag

SEQ ID NO: 20212 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcacccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20213 - DNA, 397 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgacccttacttctcctggaaatgcccgaggcatagactgtaccccaaacaaacagtcataactcattgacgccaccattccaacaccggctccctcgagagagacgaagtgtttgtccccaagaagaagtcagacatcaagtggtacggaaagtacctcaacaggccgcgaggacgcacggtgatgcgaaccgtccagttcacgatcggctgcccttggtccttag

SEQ ID NO: 20214 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatagacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20215 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20216 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccgccacgccttcagcgactaccagtggcttgacgacaccgtcggtctcatcttccactccttcctcctcgtcccttacttctcctggaagtaacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20217 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20218 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggcttgcctttgtacttag

SEQ ID NO: 20219 - DNA, 360 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 20220 - DNA, 310 bp, Artificial
  Mutation in BnaC.FAD2.a introduced by TALE nuclease pair BnFAD2_T02
cctctcctccctcaccctctctcctacttcgcctggcctctctactggacctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20221 - DNA, 358 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcacagcccacgagtgcggccaccacgccttcagcgactaccagtggcttgacgacaccgtcggtctcatcttccactccttcctcctcgtcccttacttctcctgggagtgtcatcgacgccaccattccaacactggctccctcgagagagacgaagtgtttgtccccaagaagaagtcaaacgtcaagtggtacggcaagtaccgcagcatccctttgggacgcactgtgatgttaaccgttcagttgacgctcggctggcatttgtgcttag

SEQ ID NO: 20222 - DNA, 356 bp, Artificial
  Mutation in BnaC.FAD2.a introduced by TALE nuclease pair BnFAD2_T02
cctctcctccctcaccctctctcctacttcgcctggcccctccactgggcctgcccagggagcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaggtgtttgtccccaagaagaagtcagacatcaagtggtacggcaagtacctcagcaacccttggggacgcaccggggtgttaaccgttccattcacgctcggctggcctttgtacttag

SEQ ID NO: 20223 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcgaccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgaggctaaccgtccagttcacgctcggctggcctttgtacttag

SEQ ID NO: 20224 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctgtgtacttag

SEQ ID NO: 20225 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccataaaacaaagttaaacattgggcttcctggagccgcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 20226 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagtgtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacacccccttgggacgcaccgtgatgttaacggttaagttcactctcggctggcctttgtacgtag

SEQ ID NO: 20227 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20228 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacggtcggctggccttggtacttag

SEQ ID NO: 20229 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccatcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20230 - DNA, 357 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacaccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 20231 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaattacctcaacaacccgctaggacgcactgtgatgctaaccgtccagttcacgctcggctggcctttgtacttag

SEQ ID NO: 20232 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccccgccttcagcgactaccagtggctttacgacaccgtcggtctcctcttccactccttcctcctcgtcccttacttctcctggaaagtcatcgacgccaccagtccaacactcgctccctcgagagagacgaagtgtctgtccccaagaagaactcacacatcaagtggtacggcaagaacctcaacaccccttggggacgcaccgtgatgttaaccgttcagttcacgctcgtctggcctttgtactgag

SEQ ID NO: 20233 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacagcaagtggtacggcaagtacctcaacaaccctttgggacgcaccgtgaggttaacgtttcagttcactcgtggctggcctttgtacttag

SEQ ID NO: 20234 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagctactaccagtggcttgacgacaccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20235 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagcgcctcaacaaccctttgggacgaaccgtgatgttcacggttcagttcactcgcggctgccctttgtacttag

SEQ ID NO: 20236 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 20237 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcctgacgacaccgtcggtctcatcttccactccttcctcctcgtcccttacttctcctggagtcatcgacgccaccattccaacactggctccctcgagagagacgacgtgtttgtccccaagaagaagtcagacatcaagtggtacggcaagtacctcaacaacccgctgggacgccccgtgatgttaacggttcagttcactctcggctggcctttgtacttag

SEQ ID NO: 20238 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 20239 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20240 - DNA, 436 bp, Artificial
  Mutation in BnaC.FAD2.a introduced by TALE nuclease pair BnFAD2_T02
cctctctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtaccgtctccagcggctgttgccggtgctgtgccaggcccacggcttgaccccggagcaggtggtggccatcgccatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20241 - DNA, 357 bp, Artificial
  Mutation in BnaC.FAD2.a introduced by TALE nuclease pair BnFAD2_T02
cctctcctccctcaccctctctcctacttcgcctggcctctctaatgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaaggacctcaacaaccctttgggacgcaccgtgatgttaacggttcagttctctctcggctggcctttgtacttag

SEQ ID NO: 20242 - DNA, 357 bp, Artificial
  Mutation in BnaC.FAD2.a introduced by TALE nuclease pair BnFAD2_T02
cctctcctccctcaccctctctcctacttcgcctggcctctctactgggcctgacaagggtgcgtcctaaccggcgtctgtgtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttgcgtacgcaccgtgatgttatcggttcagttctctctcgtctggcctttgtacttag

SEQ ID NO: 20243 - DNA, 362 bp, Artificial
  Mutation in BnaC.FAD2.a introduced by TALE nuclease pair BnFAD2_T02
cctctcctccctcaccctctctcctacttcgcctggcctctctactgcgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaaccaccctttgggacgcaccgtgatgttaacggttcagttcactctcggctgccctttgtacttag

SEQ ID NO: 20244 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20245 - DNA, 355 bp, Artificial
  Mutation in BnaC.FAD2.a introduced by TALE nuclease pair BnFAD2_T02
cctctcctccccaccctctctcctacttcgcctggcctctctactgggcctgccaacggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacgaccctgtgggacgcgccgtgatgttaacggttcagttcactctcggctggcctttgtacttag

SEQ ID NO: 20246 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgattttaacgatacagttcactctcggctgccctttgtacttag

SEQ ID NO: 20247 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20248 - DNA, 330 bp, Artificial
  Mutation in BnaC.FAD2.a introduced by TALE nuclease pair BnFAD2_T02
cctctcctccctcaccctctctcctacttcgcctggcctctctactgggcctgccaagtgtgcgtcctaaccggcgtctgggtcatagcccacgagtgcggccaccacgccttcagcgactaccagtggcttgacgacaccgtcggtctcatcttccactccttcctcctcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20249 - DNA, 321 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgatggccaccacctgctgaggggtcaagccgtgggcctggcacagcaccggcaacagccgctagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20250 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgcattcagcgactaccagtggcttgacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 20251 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccatgatgttaacggttcagttcactcgcggctggcctttgtacttag

SEQ ID NO: 20252 - DNA, 357 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20253 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgcgcggctggcctttgtccttag

SEQ ID NO: 20254 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgatctcatcttccactccttcctcctcgtccattacttctcctggaaagtcatcgacgccaccattccaacactggctccctcgagagagacgaagtgtttgtccccaagaagaagtcagacatcaagtggtacggcaagtacctcaacacccctttgggacgcatcgtaatgttaacgggtcaggtgtctgtcggctgtcctttgtacgtag

SEQ ID NO: 20255 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcaatggcgatggcaagcaggcgctggagacggtcatcgacgccaccattccaacactggctccctcgagagagacgaagtgtttgtccccaagaagaaggcagacatcaagtggtacggcaagtacctcaacaaccctttgggacgcaccgtgatgttaacggttcagttcactctcggctggccgttgtacttag

SEQ ID NO: 20256 - DNA, 343 bp, Artificial
  Mutation in BnaC.FAD2.a introduced by TALE nuclease pair BnFAD2_T02
cctctcctccctcaccctctgtcctacttcgcctggcctctctcctgagcctgccaagggcgcgtcctaaccggcgtctgggtcatagcccacgagtgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagaagtcagccatcaagtggtacggcaaaaaccacagcaaccctctggaacgccccgtgaggttaacggtgcaggtcactcgcgcctgccctttgtacttag

SEQ ID NO: 20257 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20258 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttgactctcggctggcctttgtacttag

SEQ ID NO: 20259 - DNA, 318 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacatccctttgggccgcaccgtgatgttaaccggtcagttgacgcccggctggcctttgtgcttag

SEQ ID NO: 20260 - DNA, 323 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgctcgccgcagccgaacgaccgagaagaagtcagacatcaagttgtacggcaagtacctcaacaaccctttgggacgcaccgtgatgttaacggttcagttcactctcggctggcctttgtacttag

SEQ ID NO: 20261 - DNA, 315 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccaatggcggtggcaagcaggcgctggagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 20262 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctgtgtacttag

SEQ ID NO: 20263 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggcgcgccctaaccggcgtctgggtcttagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctttgggacgcaccgtgatgttaacagatcagttcactctcggctggcctttgtacttag

SEQ ID NO: 20264 - DNA, 392 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagactgagcctttcgttttatctgttgtttgtcggtgaacgctcgacgccaccattccaacactggctccctcgagagagacgaagtgtttgtccccaagaagaagtcagacatcacgtggtacggcaagtacctcaacagccctttgggacgcaccgtgatgctaccggttcagttccctctcggctggcctttgtacttag

SEQ ID NO: 20265 - DNA, 330 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20266 - DNA, 349 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20267 - DNA, 354 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20268 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20269 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcgacgccaccattccaacactggctccctcgagagagacgaagtgtttgtccccaagaagaaatccgacatcaagtggtacggcaagtacctcaacaacccttggggacgcaccgtgatgttaacggttcagttcactctcggctggcctttgtacttag

SEQ ID NO: 20270 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctctgggacgcaccgtgatgttaacggttcagttcactctcggctgccctttgtacttag

SEQ ID NO: 20271 - DNA, 329 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggcttgacgacaccgtcggtctcatcctccacttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20272 - DNA, 350 bp, Artificial
  Mutation in BnaC.FAD2.a introduced by TALE nuclease pair BnFAD2_T02
cctctcctccctcaccctctaccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactcctttctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20273 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 20274 - DNA, 358 bp, Artificial
  Mutation in BnaC.FAD2.a introduced by TALE nuclease pair BnFAD2_T02
cctctcctccctcaccctctctcctacttcgcctggcctctctactgggcctgacaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccacctttccaacactggctccctcgagagagacgaagtgtttgtccccaataagaagtcacacatcaagtggtacggcaagttcctcaacaagcctttgggacgccccgtgatgctaacggttcaggtgactcgcgcccgtcctttgtgcttag

SEQ ID NO: 20275 - DNA, 362 bp, Artificial
  Mutation in BnaC.FAD2.a introduced by TALE nuclease pair BnFAD2_T02
cctctcctccctcaccctctcccctacttcgcctggcctctataatgggcctgacaagggtgcgtcctaaccggcgtctgggtcatagcccacgagtgcggccaccacgacttcagcgactaccagtggcttgacgacaccgtcggtctcatcttccactccttcctcctcgtcccttacttctcctggaagtcacagccatcgacgccaccattccaacaccggatccctcgagagggatgaagtgttcgtccccaagaagaaagccgacatcaagtggtacggcaagtacctcagcaaccctttgggacgcaccgttatgttaacgtttcaggtcactgttgtctgtcctatatacttag

SEQ ID NO: 20276 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcgaccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20277 - DNA, 356 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20278 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgaccccgtcggtctcatcttccactccttcctcctcgtcccttacttctcctggaagtacgtcatctacgccaccattccaacactggctccctcgagagagacgaagtgtttgtccccaagaagaagtcagacatcaagtggtacggcaagtacctcaacaaccctttgggacgcaccgttatgttaacggttcagttcactcgcggcgggcctttgtacttag

SEQ ID NO: 20279 - DNA, 348 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20280 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 20281 - DNA, 412 bp, Artificial
  Mutation in BnaC.FAD2.a introduced by TALE nuclease pair BnFAD2_T02
cctctcctccccaccctttgtcctacttcgcctggcctccctactgggcctgccaagggtgcgtcctaaccggcgtctgggtcatagcccacgagtgcggccaccacgccttcagcgactaccagtggcttgacgaccccgtcgggctcatcttcccctccttcctcctcgtcccttacttctcctggaagtggcacagcaccggcaacagagcctgcaccgtctccagcgcctgcttgccaccaatatcagcgacgccaccattccaacactggctccctcgagagagacgaagtgtttgtccccaagaagaagtcagacatcaagtggtacggcaagtaccgcaacaacccttggggacgcaccgtgatggtaacggttcagttcactcgcgtctggccttggtacttag

SEQ ID NO: 20282 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagactaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20283 - DNA, 356 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgctccgtgatgttaacggttcagttcactctcggctggcctttgtacttag

SEQ ID NO: 20284 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccactccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20285 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattcaaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 20286 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcgctctcggctggcctttgtacttag

SEQ ID NO: 20287 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttaacgacaccgtcggtctcatcgacgccaccattccaacaccggatccctcgagagggatgaagtgttcgtccccaagaagaagtcagacatcaagtggtacggcaagtacctcaacaaccttttgggacgcaccgggatgttaacggttcatttcactcgtgcctggcctgtgtacttag

SEQ ID NO: 20288 - DNA, 357 bp, Artificial
  Mutation in BnaC.FAD2.a introduced by TALE nuclease pair BnFAD2_T02
cctctcctccctcaccctctctcctacttcgcctggcctctctactgggcctgacaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaacccgcgaggacgcacggtgatgctaaccttccagttcacgctaggctggcctttgtacttag

SEQ ID NO: 20289 - DNA, 310 bp, Artificial
  Mutation in BnaC.FAD2.a introduced by TALE nuclease pair BnFAD2_T02
cctctcctccctcaccctctctcctacttcgcctggcatctctcctgggcctgccaagggtgcgtcctaaccggcgtctgggtcatagcccactagtgcggccaccacgccttcagcgactatcagtggcttgacgacaccgtcggtctcatcttccaccattccaacactggctccctcgagagggatgaagtgttcgtccccaagaagaaatccgacatcgagtggtacggaaagtacctcaacaacccgctaggacgcacggtgattctacccttccaggtcacgcgcgcccgccctgagtacttag

SEQ ID NO: 20290 - DNA, 356 bp, Artificial
  Mutation in BnaC.FAD2.a introduced by TALE nuclease pair BnFAD2_T02
cctctcctccctcaccctctctcctacttcgcctggcctctctcctgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcagcaaccgtttgggacgcagcgtgagtttaacggttcagttcagtctcggctggcctttgtgcttag

SEQ ID NO: 20291 - DNA, 291 bp, Artificial
  Mutation in BnaC.FAD2.a introduced by TALE nuclease pair BnFAD2_T02
cctctcctccctcaccctctatcctacttcgcctggccttcctactgggcctgccaaggctgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggatggcctttgtacttag

SEQ ID NO: 20292 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 20293 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaacgggcctctgggtcatcgcccacgaatgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcaggcctttgtacttag

SEQ ID NO: 20294 - DNA, 356 bp, Artificial
  Mutation in BnaC.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20295 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 20296 - DNA, 345 bp, Artificial
  Mutation in BnaC.FAD2.a introduced by TALE nuclease pair BnFAD2_T02
cctctcctcctcaccctatctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20297 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactcgcggctggcctttgtacttag

SEQ ID NO: 20298 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcctctgggtcatagcccacgagtgcggccaccacgacttcagcgactaccagtggcttgacgacaccgtcggtctcatcttccactccttcctcctcgtcccttacttctcctggacgtcatcgacgccaccattccaacactggctccctcgagagagacgaagtgtttgtccccaagaagaagtcagacatcaagtggtacggcacttacctcagcaaccgtttgggacgcaccgggatgttaacggttccgttcactctcggctggcctttgtacttag

SEQ ID NO: 20299 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 20300 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctgtacgacaccgtcggtctcatcttccactccttcctcctcgtcccttacttctcctggacgccattgctggcgatggccaccacctgctggggggtcagtcatcgacgccaccattccaacactggctccctcgagagagacgaagtgtttgtccccaagaagaagtcagacatcaagtggtacggcaagtacctcaacaaccctttgggacgcaccgggaggttaacggttcagttcactctcgtcgggcctttgtacttag

SEQ ID NO: 20301 - DNA, 444 bp, Artificial
  Mutation in BnaC.FAD2.a introduced by TALE nuclease pair BnFAD2_T02
cctctcctccctcaccctctcacctacttcgcctggcctatctaatgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcttcgagccagccacgatcgacattgatctggctatcttgctgacaaagtcgctggggacggaccaacggctggtgccggtgcagtcatcgacgcctccatcccaacactggctccctcgagagagacggagtgtttgtccccgagaagaagacaaacatcgagtggtacggcgaagacctcaacaaccctttggaacgcaccgtgatgttaccgttgcatgtcacttgtgggcggcctgtgtacttag

SEQ ID NO: 20302 - DNA, 354 bp, Artificial
  Mutation in BnaC.FAD2.a introduced by TALE nuclease pair BnFAD2_T02
cctctcctccctcagcctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 20303 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggttcaggtcactctcggctggcctgtgtacttag

SEQ ID NO: 20304 - DNA, 322 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggcaagtacctcaacaaccctttgggacgcgccgtgatgttaacgggtcagttcactctcggctggcctttgtacttag

SEQ ID NO: 20305 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttcacgacaccgtcggtctcatcttccactccttcctcctcgtccctttcttctcctggaacagtcatcgacgccaccattccaacactggctccctcgcgagagacgaagtgtttgtccccaagaagaagtcaaacatcaagtggtacggcaagtacctcaacaaccctttgggacgcaccgtgatgttaacggttcagttcactctcggctggcctttgtacttag

SEQ ID NO: 20306 - DNA, 356 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctttgtacttag

SEQ ID NO: 20307 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaagtcagacatcaagtggtacggaaaggacctcaacaacccgcgaggacgcacggtgatgctagccgtccatttcgcgctcgtctggcctttgtacttag

SEQ ID NO: 20308 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggtcgcaccgtgatgttaacggttcagttcactctcggctggcctgtgtacttag

SEQ ID NO: 20309 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20310 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaaggacctcaacaacccttggggacgcaccgtgatgttaacggttcagttcactctcggctggcctttgtacttag

SEQ ID NO: 20311 - DNA, 433 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtaatcgcccacgaatgcggccaccacgccttcagcgactaccagtggcttgacgacaccgtcggtctcctcttccactccttcctcctcgtcccttacttctcctggaagtaacagcggctgttgccggtgctgtgccaggcccacggcttgaccccccgggcccgggatccgatccaatgctattaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20312 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaggcagacatcaagtggtacggcaagtacctcaacaacccttggggacgcaccgtgatgttaacggttcagttcactctcggctggcctgtgtacttag

SEQ ID NO: 20313 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20314 - DNA, 357 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20315 - DNA, 434 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatggcggcaagcaggcgctggagacggtccagcggctgttgccggtgctgtgccaggcctacggcttgaccccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20316 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccggtggcttgacgacaccgtcggtctcatcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttcggacgcgccgtgatgttaacgtttcagttcactctcggctggcctttgtccttag

SEQ ID NO: 20317 - DNA, 352 bp, Artificial
  Mutation in BnaC.FAD2.a introduced by TALE nuclease pair BnFAD2_T02
cctctcctccctcaccctctctcctacttcgcctggcctctctaatgagcctgccaagggagcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20318 - DNA, 355 bp, Artificial
  Mutation in BnaC.FAD2.a introduced by TALE nuclease pair BnFAD2_T02
cctctcctccctcaccctctctcctacttcgcctggcctccttactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggcaattgcctcaacaaccctgtgggacgcaccgtgatgttaacggtgcagttcactggcggctggcctttgtacttag

SEQ ID NO: 20319 - DNA, 356 bp, Artificial
  Mutation in BnaC.FAD2.a introduced by TALE nuclease pair BnFAD2_T02
cctctcctccctcaccctctcccttacctcgcctggcccctctacttggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20320 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgagtctaaccgtccagttcacgctcggctggcctttgtacttag

SEQ ID NO: 20321 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaaatcagacatcaagtggtacggaaagtacctcaacaacccgctaggacgcacggtgatgctaaccgtccagttcacgctcggctggcctttgtacttag

SEQ ID NO: 20322 - DNA, 356 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 20323 - DNA, 292 bp, Artificial
  Mutation in BnaC.FAD2.a introduced by TALE nuclease pair BnFAD2_T02
cctctcctccctcaccctctatcctacttcgcctggcctctctactgcgcctgccaagggtgcgtcctaaccggcgtctgggtcatagcccacgagtgcggccaccacgccttcagcgactaccagtgtcatcgacgccaccattccaacactggctccctcgagagagacgaagtgtttgtccccaagaagaagtcagacatcaagtggtacggcaagtacctcaacaacccttttggacgcaccgtgatgttagcgggtcagttcacgcgcggctggcctttgtacttag

SEQ ID NO: 20324 - DNA, 322 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20325 - DNA, 273 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcgacgccaccattccaacaccggatccctcgagagggatgaagtgtttgtccccaagaagaaggcagacatcaagtggtacggcaagtacctcaacaaccctttgggacgcaccgggatgttaacggttcagttcactctcggctggcctttgtacttag

SEQ ID NO: 20326 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccaccccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20327 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcacggtgaggctaacctgccagttcaggcgcggctggcctgggtacttag

SEQ ID NO: 20328 - DNA, 412 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctgtcctttatacttag

SEQ ID NO: 20329 - DNA, 336 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20330 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 20331 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctttgtacttag

SEQ ID NO: 20332 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggccggcctttgtacttag

SEQ ID NO: 20333 - DNA, 359 bp, Artificial
  Mutation in BnaC.FAD2.a introduced by TALE nuclease pair BnFAD2_T02
cctctcctacctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20334 - DNA, 336 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 20335 - DNA, 346 bp, Artificial
  Mutation in BnaC.FAD2.a introduced by TALE nuclease pair BnFAD2_T02
cctctcctccctcaccctctcccttacctagcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20336 - DNA, 365 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaacagtcatcgacgccaccattccaacactggctccctcgagagagacgaagtgtttgtccccaagaagaagtcagacatcaagtggtacggcaagtacctcaacaaccctgtgggacgcaccgggaggttaacggttcagttcactctcggctggcctttgtacttag

SEQ ID NO: 20337 - DNA, 357 bp, Artificial
  Mutation in BnaC.FAD2.a introduced by TALE nuclease pair BnFAD2_T02
cctctcctccctcaccctctctcctacttcgcctggcatctctcctgggcctgccaagggagcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacgttgcatttcacttgcggctggcctgtgtacttag

SEQ ID NO: 20338 - DNA, 359 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20339 - DNA, 345 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20340 - DNA, 355 bp, Artificial
  Mutation in BnaC.FAD2.a introduced by TALE nuclease pair BnFAD2_T02
cctctcctccctcaccctctctcctacttcgcctggcatctctaatgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgcgcggctggcctttgtacttag

SEQ ID NO: 20341 - DNA, 355 bp, Artificial
  Mutation in BnaC.FAD2.a introduced by TALE nuclease pair BnFAD2_T02
cctctcctccctcaccctctcacttacctcgcctggcacatctaatgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgggatgttaacgtttcagttcactctcgtctggcctgtgtacttag

SEQ ID NO: 20342 - DNA, 352 bp, Artificial
  Mutation in BnaC.FAD2.a introduced by TALE nuclease pair BnFAD2_T02
cctctcctccctcaccctctctcctacttcgcctggcttctctactgggcctgccaagggtgcgtcctaaccggcgtctgggtcatagcccacgagtgcggccaccacgccttcagcgactaccagtcgcttgacgacaccgtcggtctcatcttccactccttcctcctcgtcccttacttctcctggaatcgacgccaccattccaacactggctccctcgagagagacgaagtgtttgtccccaagaagaagtcacacatcacgtggtacggcaagtacctcaacatccctctgggccgcaccctgattctaacggttcagttcactctcggctggcctttgtacttag

SEQ ID NO: 20343 - DNA, 357 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20344 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20345 - DNA, 396 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaatgcccgaggcatagactgtaccccaaaaaacagtcataagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20346 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 20347 - DNA, 355 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20348 - DNA, 356 bp, Artificial
  Mutation in BnaC.FAD2.a introduced by TALE nuclease pair BnFAD2_T02
cctctcctccctcaccctctctcctacttcgcctggcatctctcctgagcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcgagtacctcaacaaccctttgggacgcaccgtgatgttaacggttcagttcactctcggctggcctgtgtacttag

SEQ ID NO: 20349 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccctcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20350 - DNA, 396 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggacaccacgccttcagcgactaccagtggcttgacgacaccgtcggtctcatcttccactccttcctcctcgtcccttacttctcctggaatcaatttgttgcaacgaacaggtcactatcagtcaaaacagtcatcgacgccaccattccaacacaggatccctcgagagggatgaagtgttcgtccccaagaagaaatccgacatcaagtggtacggaaagtacctcaacaacccgctaggacgcacggtgatgctaaccgtccctttcccgctcggctggcctttgtccttct

SEQ ID NO: 20351 - DNA, 449 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaatcacggcctggcacagcaccggcaacagccgctggaccgtctccagcgcctgcttgccaccgccattgctggcgatggccaccacctgctacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20352 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctagcctttgtacttag

SEQ ID NO: 20353 - DNA, 352 bp, Artificial
  Mutation in BnaC.FAD2.a introduced by TALE nuclease pair BnFAD2_T02
cctctcctccctcaccctctaccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20354 - DNA, 357 bp, Artificial
  Mutation in BnaC.FAD2.a introduced by TALE nuclease pair BnFAD2_T02
cctctcctccctcaccctctctcctacttcgcctgccatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctgtatacttag

SEQ ID NO: 20355 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctgtgggacgcgccgtgaggttaacggttcagttcactctcggctggcctttgtacttag

SEQ ID NO: 20356 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 20357 - DNA, 318 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20358 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgaatgcggccaccacgccttcagcgaccaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20359 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgtctttgtccccaagaagaagtcagacatcaagtggtacggcaagtacctcaacaaccctttgggacgcaccgtgatgttaacggttcagttcactctcggctggacttttacttag

SEQ ID NO: 20360 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgtctttgtccccaagaagaagtcagacatcaagtggtacggcaagtacctcaacaaccctttgggacgcaccgtgatgttaacggttcagttcactctcggctggccttttacttag

SEQ ID NO: 20361 - DNA, 357 bp, Artificial
  Mutation in BnaC.FAD2.a introduced by TALE nuclease pair BnFAD2_T02
cctctcctccctcaccctctctcctacttcgcctggcctctctcctgagcctgccaagggcgcgtcctaaccggcgtctgggtcatagcccacgagtgcggccaccacgccttcagcgactaccagtggcttcacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagttcctcaacaaccgtctgggacgcaccgtgatgttaacgtttcagttcactcgcggctggcctttgtacttag

SEQ ID NO: 20362 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 20363 - DNA, 344 bp, Artificial
  Mutation in BnaC.FAD2.a introduced by TALE nuclease pair BnFAD2_T02
cctctcctccctcaccctctatcctacttcgcctggcttctctactgcgcctgccaagggcgcgtcctaacaggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgcctggcctttgtacttag

SEQ ID NO: 20364 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 20365 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20366 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctgtgggacgcaccgtgaggttaacggttcaggtcactctcggctggcctttgtacttag

SEQ ID NO: 20367 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccttgatgttaacggttcaggtcacgctcggctggcctttgtacttag

SEQ ID NO: 20368 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccccgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20369 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 20370 - DNA, 356 bp, Artificial
  Mutation in BnaC.FAD2.a introduced by TALE nuclease pair BnFAD2_T02
cctctcctccctcaccctctaccttacctcgcctgtcctctctactgcgcctgccaagggtgcgtcctaaccggcgtctgggtcatagcccacgagtgcagccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccatgtgggacgcaccgtgatggtaacggttcagttcactctcggctggcctttgtacttag

SEQ ID NO: 20371 - DNA, 359 bp, Artificial
  Mutation in BnaC.FAD2.a introduced by TALE nuclease pair BnFAD2_T02
cctctcctccctcaccctctatcctacttcgcctggcctctctcctgagcctgccaagggtgcgtcctgaccggcgtctgggtcatagcccacgagtgcggccaccacgccttcagcgactaccagtggcttcacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcgccgtgatgttagcggttcagttcactctcggctggcctttgtacttag

SEQ ID NO: 20372 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20373 - DNA, 354 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20374 - DNA, 448 bp, Artificial
  Mutation in BnaC.FAD2.a introduced by TALE nuclease pair BnFAD2_T02
cctctcctccctcaccctctctcatacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtactccagcgcctgcttgccgccatcgtggctggcgatggccaccacctgctccggggtcaagccgtgggcctggcacagcaccggcaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 20375 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 20376 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20377 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20378 - DNA, 364 bp, Artificial
  Mutation in BnaC.FAD2.a introduced by TALE nuclease pair BnFAD2_T02
cctctcctccctcaccctctctcctacttcgcctggattctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacacagtcatcgacgccaccattccaacactggctccctcgagagagacgaagtgtttgtccccaagaagaagtcagacatcaagtggtacggcaagtaccccaacaaccctttgggacgcgccgtgatggtaacggttcaagtcactctcggctgccctttgtacttag

SEQ ID NO: 20379 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacacccctttgggacgcaccgtgatgttaacgggtcagttcactctcggctggcctttgtacttag

SEQ ID NO: 20380 - DNA, 336 bp, Artificial
  Mutation in BnaC.FAD2.a introduced by TALE nuclease pair BnFAD2_T02
cctctcctccctcaccctctctcctacttcgcctggcctctttcctgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggtgcatgtcactcgcgtgtggcatgtgtacttag

SEQ ID NO: 20381 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20382 - DNA, 353 bp, Artificial
  Mutation in BnaC.FAD2.a introduced by TALE nuclease pair BnFAD2_T02
cctctcctccctcaccctctctcctacttcgcctggcctctctcctgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtcgacgccaccattccaacactggctccctcgagagagacgaagtgtttgtccccaagaagaagtcagacatcaagtggtacggcaagtacctcagcaagcctgtgggacgcaccgtgagtttaagggttcaggtgactcccggctggcctttgtgcttag

SEQ ID NO: 20383 - DNA, 356 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagtgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20384 - DNA, 356 bp, Artificial
  Mutation in BnaC.FAD2.a introduced by TALE nuclease pair BnFAD2_T02
cctctcctccctcaccctctctcctacttcgcctggcctctctaatgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20385 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgttatgttaacggttcagttcactctcggctggcctttgtgcttag

SEQ ID NO: 20386 - DNA, 357 bp, Artificial
  Mutation in BnaC.FAD2.a introduced by TALE nuclease pair BnFAD2_T02
cctctcctccctcaccctctctcctacttcgcctggactctctactgggcctgccaagggcgcgtcctaaccggcgtctgggtcatagcccacgagtgcggccaccacgccttcagcgactaccagtggctttacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgctccgtgatgttaacggttcagttcactcgcggctggcctttgtacttag

SEQ ID NO: 20387 - DNA, 335 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 20388 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagttgtacggcaagtacctcaacaaccctttgggacgcaccgtgatgctaacggttcagttcactctcggctggcctttgtacttag

SEQ ID NO: 20389 - DNA, 352 bp, Artificial
  Mutation in BnaC.FAD2.a introduced by TALE nuclease pair BnFAD2_T02
cctctcctccctcaccctctatcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaaggcagacatcaagtggtacggcaagtacctcaacaaccctttgggacgcaccgtgatgttatcgttgcagttcactctcggctggcctttgtacttag

SEQ ID NO: 20390 - DNA, 359 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaacaggcgtctgggtcatagcccacgagtgcggccaccacgccttcagcgactaccagtggcttgacgaccccgtaggtctcatcttccactccttcctcctcgtcccttacttctcctggaagtagccatcgacgccaccattccaacaccggatccctcgagagggatgaagtgttcgtccccaagaagaagtcagacagcaagtggtacggcaagtacctcaacaacccttggggacgcaccgtgatgttaacggttcagttcactctcggctggcctttgtacttag

SEQ ID NO: 20391 - DNA, 310 bp, Artificial
  Mutation in BnaC.FAD2.a introduced by TALE nuclease pair BnFAD2_T02
cctctcctccctcaccctctctcctacttcgcctggcctctctactggacctgacaagggtgcgtcctaaccggtgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgaggttaacggttccgttcactctcggcgggcctttgtacttag

SEQ ID NO: 20392 - DNA, 358 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20393 - DNA, 352 bp, Artificial
  Mutation in BnaC.FAD2.a introduced by TALE nuclease pair BnFAD2_T02
cctctcctccctcaccctctctcctacttcgcctggcctctgtactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaataagtcagacatcaagtggtacggcaagtacctcaacaaccctttgggacgcaccgtgatgttatcgggacagttcactctcggctggcctttatacttag

SEQ ID NO: 20394 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20395 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttctctcgtggctggcctttgtacttag

SEQ ID NO: 20396 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttggcgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20397 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccgacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20398 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttggtacgcaccgtgatgttaacggttcagttcactctcggctggcctttgtacttag

SEQ ID NO: 20399 - DNA, 332 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaaatccgacatcaagtggtacggaaagtacctcaacaacccgctaggacgcacggtgatgctaaccttccagttcacgcgcggctggcctttgtacttag

SEQ ID NO: 20400 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcactgtgatgttaacggttcagttcactctcggctggcctttgtacttag

SEQ ID NO: 20401 - DNA, 345 bp, Artificial
  Mutation in BnaC.FAD2.a introduced by TALE nuclease pair BnFAD2_T02
cctctcctccctcaccctctatcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcttcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 20402 - DNA, 354 bp, Artificial
  Mutation in BnaC.FAD2.a introduced by TALE nuclease pair BnFAD2_T02
cctctcctccctcaccctctctcctacttcgcctggcctctctactgggcctgacaagggtgcgtcctaaccggcgtctgggtcctagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcagcaaccgtttgggacgcaccgtgatgttaacggttcagttcactctcggctggcctttgtacttag

SEQ ID NO: 20403 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20404 - DNA, 337 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcttccacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20405 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20406 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttttggacgcgccgtgatgttaacggttcatttcacgctcggctggcctttgtacttag

SEQ ID NO: 20407 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20408 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggccttggtacttag

SEQ ID NO: 20409 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20410 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20411 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20412 - DNA, 340 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20413 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 20414 - DNA, 341 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgcctgggtcacagcccacgagtgcggccaccacgccttcagcgactaccagtggcttgacgacaccgtcggtctcatcttccactccttcctcctcgtccagtcatcgacgccaccattccaacactggctccctcgagagagacgaagtgtttgtccccaagaagaagtcagacatcaagtggtacggggagttccgcagcgcctcttacggacgcaccttgatgataacggatcaggtgactgccggctggcctttgtgcttag

SEQ ID NO: 20415 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 20416 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20417 - DNA, 354 bp, Artificial
  Mutation in BnaC.FAD2.a introduced by TALE nuclease pair BnFAD2_T02
cctctcctccctcaccctctagcctacttcgcctggcctctttactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtccggcaagtccctcaacacccctttggtacgcaccgtgctgttaacggttcagttcactctcggctggcctttgtacttag

SEQ ID NO: 20418 - DNA, 365 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactcgcggctggcctttgtacttag

SEQ ID NO: 20419 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcgcccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaataagaagtcagacatcaagtggtacggcaaggacctcaacaaccctttgggacgcaccgtgaggttaacgattcagttcactctcggctggcctttgtacttag

SEQ ID NO: 20420 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20421 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgggctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20422 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagtgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20423 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20424 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgagtgcggccaccacgccttcagcgactaccagtggcttgacgacaccgtcggcctcctcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20425 - DNA, 318 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20426 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 20427 - DNA, 346 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20428 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgtgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20429 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttac

SEQ ID NO: 20430 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggactcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20431 - DNA, 351 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20432 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgcctaccagtggctttacgacaccgtcggactcatcttccactccttcctcctcgtcccttacttctccaggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20433 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttccgtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 20434 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggcagtcatcgacgccaccattccatcactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 20435 - DNA, 358 bp, Artificial
  Mutation in BnaC.FAD2.a introduced by TALE nuclease pair BnFAD2_T02
cctctcctcctcaccctctcccttacctcgcctggcccctctactaggcctgccaaggctgcgtcctaacgggcctctgggtcatcgcccacgaatgcggccaccacgccttcagcgactaccagtggcttgacgaccccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20436 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcatcttccactccttcctcctcgtcccttacttctcctggatcatcgacgccaccattccaacactggctcccacgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20437 - DNA, 360 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20438 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20439 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20440 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20441 - DNA, 384 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctgcaatggcgatggcaagcaggcgctggagacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20442 - DNA, 359 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20443 - DNA, 351 bp, Artificial
  Mutation in BnaC.FAD2.a introduced by TALE nuclease pair BnFAD2_T02
cctcgcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggactcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20444 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20445 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctttgggacgcaccgtgatgtaacggttcagttcactctcggctggcctttgtacttag

SEQ ID NO: 20446 - DNA, 344 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20447 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtttcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20448 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagcagaagtcacacatcaagtggtacggcaagtacctcaacaaccctctgggacgcactgtgatgttaacggctcagttcacgctcggctggcctttgtaattag

SEQ ID NO: 20449 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 20450 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcctcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20451 - DNA, 412 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcggtggacctctcaactctcccgccaccgtgagcaaggcctccagagcgcgtgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20452 - DNA, 406 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgagtcatagcccacgagtgcggccaccacgccttcagcgactaccagtggcttgacgacaccgtcggtctcatcttccactccttcctcctcgtcccttacttctcctggaagtactccagcgcctgcttgccaccattattgctggcgatggccaccacctgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20453 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagttgcttgacgacaccgtcggtctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20454 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20455 - DNA, 358 bp, Artificial
  Mutation in BnaC.FAD2.a introduced by TALE nuclease pair BnFAD2_T02
cctctcctccctcaccctctctcctacttcgcatggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtttcatcgacgccaccattccaacactggctccctcgagagagacgaagtgtttgtccccaagaagaagtcagacatcaagtggttcggcaagtacctcaacaacccgtttggacgcaccgggatgtaaacggttctgttcactcgcggctggcctttgtacttat

SEQ ID NO: 20456 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20457 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccatgggtgcgtcctaaccggcgtctgggtcatagcccacgagtgcggccaccatgccttcagcgactaccagtggcttgacgacaccgtcggtctcatcttccactccttcctcctcgtcccttacttctcctggaagtaccggataccggatccctcgagagggatgaagtgttcgtccccaagaagaaatccgacatcaagtggtacggaaagtacctcaacaccccgctcggacgcgcgggaaggctaaacgtccaggccacgcccggctggcctttgtacttaa

SEQ ID NO: 20458 - DNA, 408 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgtggccaccacgccttcagcgactaccagtggcttgacgacaccgtcggtctcatcttccactccttcctcctcgtcccttacttctcctggaagtgtgatgctcgtcaggggggcggagcctatggaaaaacgccagcaacgacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20459 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgcgatgttaacggttcagttcactctcggctggcctttgtacttag

SEQ ID NO: 20460 - DNA, 356 bp, Artificial
  Mutation in BnaC.FAD2.a introduced by TALE nuclease pair BnFAD2_T02
cctctcctccccaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20461 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtctgtctcatcttccactccttccccctcgtcccttacttctcctggaagtcatcgacgccaccattccaacactggctccctcgagagagacgaagtgtttgtccccaagaagaagtcagacatcgagtggtacggcgggtacctcaacaagcgtttgggacgcagcgtggtgttaacggtacgattcactctcggctggccttagcgcttag

SEQ ID NO: 20462 - DNA, 359 bp, Artificial
  Mutation in BnaC.FAD2.a introduced by TALE nuclease pair BnFAD2_T02
cctctcctccctcaccctctcccttacctcgcctggcccctctactgggcctgtcaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20463 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 20464 - DNA, 344 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20465 - DNA, 430 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggtggctcgagggttatttgccgactaccttggtgatcttctagtgtagccgtagttaggccaccacttcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20466 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 20467 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20468 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20469 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20470 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactacttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20471 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 20472 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggccgcaccgtgatgttaacggttccgttcactctcggctggcctttgtacttag

SEQ ID NO: 20473 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 20474 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcacacatcacgtgttacggcaagtacctcaacatccctgtgggccgccccgtgaggttaacggttcagttcactcccggctggcctttgtacctat

SEQ ID NO: 20475 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacataaagtggtacggcaagtacctcaacaaccctttgggacgcaccgtgatgttaacggttcagttcactctcggctggcctttgtactgag

SEQ ID NO: 20476 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20477 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20478 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttat

SEQ ID NO: 20479 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttttacttag

SEQ ID NO: 20480 - DNA, 363 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20481 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcagcgtgatgttaacggttcagttcactctcggctggcctttgtacttag

SEQ ID NO: 20482 - DNA, 453 bp, Artificial
  Mutation in BnaC.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgatgttccagattacgctatcgatatcgccgatctacgcacgctcggctacagccagcagcaacaggagaagatcaaaccgaaggttcgttcgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20483 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 20484 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgcctaccagtggcttgacgacaccgtcggtctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20485 - DNA, 335 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 20486 - DNA, 273 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcctctgggtcatcgcccacaaatgcggccaccacgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20487 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 20488 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20489 - DNA, 291 bp, Artificial
  Mutation in BnaC.FAD2.a introduced by TALE nuclease pair BnFAD2_T02
cctctcctccctcaccctctctcctacttcgcctggcctctctactgggccttccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20490 - DNA, 425 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtcccttaacgtgagttacgcgtcgttccactgagcgtcagaccccgtagaaaagatcaaaggatcttcttggtcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20491 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20492 - DNA, 449 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcacggcctggcacagcaccggcaacagccgctggaccgtctccagcgcctgcttgccaccgccattgctggcgatggccaccacctgctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20493 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20494 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcaccgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20495 - DNA, 360 bp, Artificial
  Mutation in BnaC.FAD2.a introduced by TALE nuclease pair BnFAD2_T02
cctctcctccctcaccctctctcctacttctcctggcctctctactgtgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtccggcaagtaccccaacaaccctgtgggatgcacggtgctgctaccggttcagttccctctcggctggcctttgtacttag

SEQ ID NO: 20496 - DNA, 311 bp, Artificial
  Mutation in BnaC.FAD2.a introduced by TALE nuclease pair BnFAD2_T02
ccctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20497 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20498 - DNA, 432 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggaccgtctccagcgcctgcttgccaccgccattgctggcgctggccaccacctgctgggtggtcaagttgagcgggtggtacggcaccattccaacactggctccctcgagagagacgaagtgtttgtccccaagaagaagtcagacatcaagtggtccggcaagtacctcaacaaccctttgtgacgcaccgtgatgttaacggttcagttcactctcggctggcctttgtacttag

SEQ ID NO: 20499 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 20500 - DNA, 458 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagcggtccagcggctgttgcccccatcattgctggcaatggccaccacctgctggggggtcaagccgtgggcctggcacagcaccggcaccagccgctggagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20501 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgtagtgtttgtccccaagaagaagtcagacatcaagtggtacggcaagtacctcaacaaccctttgggacgcaccgtgatgttaacggttcagttcactctcggctggcctttgtacttag

SEQ ID NO: 20502 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggatctagatgtattcgacgcgagagtagggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20503 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgcttgtccccaagaagaagtcagacatcaagtggtacggcaagtacctcaacaaccctttgggacgcaccgtgatgttaacggttcagttcactctcggctggcctttgtacttag

SEQ ID NO: 20504 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaggcgctaaatgaaaccttaacgctatggaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20505 - DNA, 441 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtgtgccaggcccacggcttgaccccccagcaggtggtggccatcgccggccagcaacgtcggtgcgagatggcgctcgatgacaggcatcgacgccaccattccaacactggctcccgcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20506 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacctcaagtggtacggcaagtacctcaacaaccctttgggacgcaccgtgatgttaacggttcagttcactctcggctggcctttgtacttag

SEQ ID NO: 20507 - DNA, 434 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatggcggcaagcaggcgctggagacggtccagcggctgttgccggtgctgtgccaggcccacggcttgaccccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20508 - DNA, 354 bp, Artificial
  Mutation in BnaC.FAD2.a introduced by TALE nuclease pair BnFAD2_T02
cctctcctccctcaccctctctcctacttcgcctggcctctctactcggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20509 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgcccggctggcctttgtacttag

SEQ ID NO: 20510 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactcag

SEQ ID NO: 20511 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcgccgtgatgttaacggttaaggtcactcttggctggcctttgtacttag

SEQ ID NO: 20512 - DNA, 447 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcaatgacattcttgcaggtatcttcgagccagccacgatcgacattgatctggctatcttgctgacaaaagcaagagaacatagcgttgcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20513 - DNA, 349 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctatcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20514 - DNA, 310 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20515 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggttatagcccacgagtgcggccaccacgccttcagcgactaccagtggcttgacgacaccgtcggtctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20516 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20517 - DNA, 352 bp, Artificial
  Mutation in BnaC.FAD2.a introduced by TALE nuclease pair BnFAD2_T02
cctctcctccctcaccctctctcctacttctcctggcctctctactgggcctgccaagtgtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 20518 - DNA, 397 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatgcccgaggcatagactgtaccccaaaaaaacagtcataagtcatcaacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20519 - DNA, 322 bp, Artificial
  Mutation in BnaC.FAD2.a introduced by TALE nuclease pair BnFAD2_T02
gctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactctcggctcgcctttgtacttag

SEQ ID NO: 20520 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgcctgccctttgtacttag

SEQ ID NO: 20521 - DNA, 467 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggaaagcgggcagtgagcgcaacgcaattaagctcgccgcgttgtttcatcaagccttacggtcaccgtaaccagcaaatcaatatcactgtgtggcttcaggccgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtgtggcctttgtgcttag

SEQ ID NO: 20522 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagttcactttcggctggcctttgtacttag

SEQ ID NO: 20523 - DNA, 358 bp, Artificial
  Mutation in BnaC.FAD2.a introduced by TALE nuclease pair BnFAD2_T02
cctctcctccctcaccctctcccttacctcgcctgacccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20524 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccccctcgtcccttacttctcctggaagtaggcgctaaatgaaaccttaacgctatggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20525 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagttgcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20526 - DNA, 357 bp, Artificial
  Mutation in BnaC.FAD2.a introduced by TALE nuclease pair BnFAD2_T02
cctctcctccctcaccctctctcctacttcgcctggcctctctactgggcctgctaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20527 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20528 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggtgcaggtcactctcggctggcctttgtacttag

SEQ ID NO: 20529 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20530 - DNA, 395 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgaccccccagcaggtggtggccatcgccagccaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20531 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 20532 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 20533 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaacatcgacgccaccattccaacacgggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20534 - DNA, 397 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaatgcccgaggcatagactgtaccccaaaaaaacagtcataagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20535 - DNA, 354 bp, Artificial
  Mutation in BnaC.FAD2.a introduced by TALE nuclease pair BnFAD2_T02
cctctcctccctcaccctctctcctacttctcctgccctctctactcttcctgccatgtgtgcgtcctcaccgccgtctgggtcatcgcccacgagttcctccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacgtcaagtagctcaacaactctgtgggatgcacggggctgctaccggttccgttcactctcggctggcctttgtacttag

SEQ ID NO: 20536 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtaccccaacaaccctttgggacgcaccgtgatgttaacggttcagttcactctcggctggcctttgtacttag

SEQ ID NO: 20537 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaaaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20538 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20539 - DNA, 355 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 20540 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccacgatggcggcaagcaggcgctggagtcatcgacgccacaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20541 - DNA, 354 bp, Artificial
  Mutation in BnaC.FAD2.a introduced by TALE nuclease pair BnFAD2_T02
cctctcctccctcaccctctctcctacttcgcctgacctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20542 - DNA, 358 bp, Artificial
  Mutation in BnaC.FAD2.a introduced by TALE nuclease pair BnFAD2_T02
cctctcctccctcaccctctctcctacttcgcctggcctatctactgggcctgccaagggtgcgtcctaaccggcgtctgggtcatagcccacgagtgcggccaccacgccttcagcgactaccagtggcttgacgacaccgtcggtctcatcttccactccttcctcctcgtccattacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 20543 - DNA, 319 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 20544 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20545 - DNA, 343 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 20546 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20547 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttcg

SEQ ID NO: 20548 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20549 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttatacttag

SEQ ID NO: 20550 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20551 - DNA, 360 bp, Artificial
  Mutation in BnaC.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcccgcccggctggcctttgtgcttag

SEQ ID NO: 20552 - DNA, 344 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 20553 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggttatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20554 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccctcggtctcatcttccactccttcctcctcgtcccttactgctcatcgacgccaccattccaacactggctccctcgagagagacgaattgtttgtccccaagaagaagtcagacatcaagtggtacggcaagtacctcaacaaccctttaggacgcaccgtgatgttaacggttcagttcactctcggctgtcctttgtacttaa

SEQ ID NO: 20555 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactcttggctggcctttgtacttag

SEQ ID NO: 20556 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 20557 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcgcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 20558 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 20559 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaaatccgccatcaagtggtacggaaagtacctcaacaacccgctaggacgcccggtgatgctaaccgtccagttcacgctcggctggcctttgtacttag

SEQ ID NO: 20560 - DNA, 443 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgcaatgcactgacgggtgccccgctcaacttgacccctctccagcgcctgcttgccgccatcgtggctggcgatggccaccaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20561 - DNA, 455 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaccgtctccagcgcctgcttgccaccattattgctggcgatggccaccacctgctggggggtcaagccgtgggcctggcacagcaccggcaacagccgcttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20562 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20563 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctattccaccattccaacactggctccctcgagagagacgaagtgtttgtccccaagaagaagtcagacatcaagtggtacggcaagtacctcaacaaccctttgggacgcaccgtgatgttaacggttcagttcactcccggctggcctttgtacttag

SEQ ID NO: 20564 - DNA, 357 bp, Artificial
  Mutation in BnaC.FAD2.a introduced by TALE nuclease pair BnFAD2_T02
cctctcctccctcaccctctctcctacttcgcctagcctctctactgtgcctgccaagggtgcgccctaaccggcgtctgggtcatcgcccacgagtgcggccaccacgccttcagcgactaccagtggcttgacgacaccgtcggtctcctcttccactccttcctcctcgtcccttacttctcctggaaagtcatcgacgccaccattccaacactggctccctcgagagagacgaagtgtttgtccccaagaagaagtcagacatcaagtgattcggcaagtacctcaacaacccttaggggcgcacgagaatgttaacgcttcagttcactctcggctagcctttgtacttag

SEQ ID NO: 20565 - DNA, 315 bp, Artificial
  Mutation in BnaC.FAD2.a introduced by TALE nuclease pair BnFAD2_T02
cctctcctccctcaccctctcccttacctcggctggcccctctactgggcctgccaagggtgcgtcctaaccggcgtctgggtcatagcccacgagtgcggccaccacgccttcagcgaccaccaatggcggtggcaagcaggcgctggagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20566 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtactgcaagtacctcaacaaccctttgggacgcaccgtgatgttaacggttcagttcactctcggctggcctttgtacttag

SEQ ID NO: 20567 - DNA, 365 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaactacagtcatcgacgccaccattccaacactggctccctcgagagagacgaagtgtttgtccccaagaagaaggcagacatcaagtggtacggcaagtacctcaacaaccctttgggacgcaccgtgatgttaacggttcagttcactctcggctggcctttgtacttag

SEQ ID NO: 20568 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggccttggtacttag

SEQ ID NO: 20569 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctttgtacttag

SEQ ID NO: 20570 - DNA, 354 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaccatgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20571 - DNA, 326 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 20572 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaaggcacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20573 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaggcgctagataaaaccttaacgctagggaacagtcatcgacgccaccattccaacactggctccctcgagagagacgaagtgttggtccccaagaagaagtcagacatcaagtggtacggcaagtacctcgacaaccctttgggacgcacggtgatgttaacggttcagttcacgctcggctggcctttgtacttag

SEQ ID NO: 20574 - DNA, 336 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtttttgtccccaagaagaagtcagacatcaagtggtacggcaagtgcctcaacaagcctgtgggacgcaccgggatgttaacggttcaggtcactctctgctgacctttgtacttag

SEQ ID NO: 20575 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20576 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcataaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtccggcaagtacctcaacaaccctttgggacgcaccgggatgttaacggttcagttcactcgcggctggccttcgtacttag

SEQ ID NO: 20577 - DNA, 451 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgcatgcatggcgcaatgcactgacgggtgccccgctcaacttgaccccaagattgcaaaacgtggcggcgtgaccgcagtggaggcagtgcatgtcatcgacgccaccattccaacactggctccctcgagagagacgaagtgtttgtccccaagaagaagtcagacatcaagtggtacggcaagtacctcaacaaccctgtgggacgcgccgtgaggttaacggttcaggtcactctcggctggccttggtacttag

SEQ ID NO: 20578 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaaggcagacatcaagtggtacggcaagtacctcaacaaccctttgggacgcaccgtgatgttaacggttcagttcactctcggctggcctttgtacttag

SEQ ID NO: 20579 - DNA, 356 bp, Artificial
  Mutation in BnaC.FAD2.a introduced by TALE nuclease pair BnFAD2_T02
cctctcctccctcaccctctctcctacttcgtctggcctctctactgtgcctgccaagggtgcgtcctaacgggcctctgggtcatcgcccacgagtgcgtccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaagcctgtgggacgcaccgtgatgttaacggttcagttcactctcggctggcctttgtacttag

SEQ ID NO: 20580 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctgccctttgtacttag

SEQ ID NO: 20581 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctcaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcagcaacccttttggacgcaccgtgaggttaacggttcaggtcactcccggctgcccttagtgcttag

SEQ ID NO: 20582 - DNA, 395 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccccacggcttgaccccccagcaggtggtggccatcgccattctccagtcatcgacgtcaccattccaacactggctccctcgagagagacgaagtgtttgtccccaagaagaagtcagacatcaagtggtacggcaagtacctcaacaaccctttgggacgcaccgtgatgttagcggttcagttcactctcggctggcctttgtactta

SEQ ID NO: 20583 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcctctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagatgaagtgtttgtccccaagaagaagtcagacatcaagtggtacggcaagtacctcaacaaccctattggtcgcaccgtgatgctaacggggcatttctctctcggctgccctttgtacttag

SEQ ID NO: 20584 - DNA, 413 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggccatcgccagccactgactcgctgcgctcggtcgttcggctgcggcgagcggtgtcatcgacgccaccattccaacactggctccctcgagagagacgaagtgtttgtccccaagaagaagtcagacatcaagtggtacggcaagtacctcaacaaccagctaggacgcacggtgatgctaaccgtccagttcacgctcggctggcctttgtacttag

SEQ ID NO: 20585 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccacaacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 20586 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 20587 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20588 - DNA, 346 bp, Artificial
  Mutation in BnaC.FAD2.a introduced by TALE nuclease pair BnFAD2_T02
cctcttctccctcaccctctctcctacttcgcctggcctctctactgggcctgccaagggtgcgtcctaacgggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20589 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtactaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacgacaagtacctcaacaaccctttgggacgcaccgtgatgttaacggtgcaggtcactctcggctggccttagtacttag

SEQ ID NO: 20590 - DNA, 352 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactcgcggctggcctttgtacttag

SEQ ID NO: 20591 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20592 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 20593 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacgggtcatttctctctcggctgtcctttgtacttag

SEQ ID NO: 20594 - DNA, 318 bp, Artificial
  Mutation in BnaC.FAD2.a introduced by TALE nuclease pair BnFAD2_T02
cctctcctccctcaccctctctcctacttcgcccggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20595 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagctactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20596 - DNA, 355 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20597 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20598 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttttggacgcaccgggatgttaacggttcagttcactcgcggctggcctttgtacttag

SEQ ID NO: 20599 - DNA, 356 bp, Artificial
  Mutation in BnaC.FAD2.a introduced by TALE nuclease pair BnFAD2_T02
cctctcctccctcaccctctcccttacctcgcctgccccctctactgggcctgccaaggctgcgtcctaacgggcgtctgggtcatagcccacgagtgcggccaccacgccttcagcgactaccagtggcttgaccacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 20600 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacgggtcaggtcactctcgcctggcctttgtacttag

SEQ ID NO: 20601 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20602 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgggtggcctgtgtacttag

SEQ ID NO: 20603 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 20604 - DNA, 379 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggtcgatcggctgcggcgagcggtacagtcatcgacgccaccattccaacactggctccctcgagagagacgaagtgtttgtccccaagaagaagtcagacatcaagtggtacggcaagtacctcaacgaccctgtggggcgcaccgtgatgttaacggttcagttcactctcggctggcctttgtacttag

SEQ ID NO: 20605 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20606 - DNA, 345 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20607 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20608 - DNA, 321 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaaccctttggaacgcaccgtgatgttaacggttcagttcactcgcgcctgccctgagtacttag

SEQ ID NO: 20609 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20610 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagaaagtcatcgacgccaccattccaacactggctccctcgagagagacgaagtgtttgtccccaagaagaagtcacacatcaagtggtacggcaagtaccccagcaagcctgatggacgcaccgtgaggcttacgcttcaggtccctctcgcctgccctttgtacttag

SEQ ID NO: 20611 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctgccctttgtacttag

SEQ ID NO: 20612 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaagcgttagagacgcatagtgatgtgaacggttcagttcaccctcggctggcctttgtacttag

SEQ ID NO: 20613 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcatcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20614 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcccttgtacttag

SEQ ID NO: 20615 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20616 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctacccggcgtctgggtcctagcccccgagtgcggccaccacgccttcagcgacttccagtggcttgacgacaccgtcggtctcatcttccactccttcctcctcgtcccttacttctcctggaagttcatcgacgccaccattccaacactggctccctcgagagagacgaagtgtttgtccccaataagaagtcagacatcaagtggtacggcaagtacctcaacaaccctttgggacgcaccgtgaggttaacgggccagttctctctcgcctggcctgagtacttag

SEQ ID NO: 20617 - DNA, 312 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctgggggacgcgccgtgaggttaacggtgcaggtcactcgcggcagcccttagtacttag

SEQ ID NO: 20618 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaaatccgacatcaagtggtacggaaagtacctcaacaacccgctaggacgcacggtgatgctaaccgcccagttcacgctcggctggcctttgtacttag

SEQ ID NO: 20619 - DNA, 358 bp, Artificial
  Mutation in BnaC.FAD2.a introduced by TALE nuclease pair BnFAD2_T02
cctctcctccctcaccctctctcctacttcgcctggcctccctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgactccaccattccaacactggctccctcgagagagacgaagtgtttgtccccaagaagaagacggacatcgagtggtacggcgagtacctcaacaaccctttgggtcgcaccgggatgttaacgttgcagttcactctcgcctgccctgtgtacttag

SEQ ID NO: 20620 - DNA, 471 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagctcttgatccggcaaacaaaccaccgctaccatggcgggcaatggccaccacctgctccgggacaaggccgagggcctggcacaccaccggcaacagccgctggaccgtctccagtcatcgacgccaccattccaacactggctccctcgagagagacgaagggtttgtccccaagaagaagtcagacatcaagtggtacggcaagtacctcaacaaccctttgggacgcaccgtgatgttaacggttcagttcactcgcggctggcctttatacttag

SEQ ID NO: 20621 - DNA, 355 bp, Artificial
  Mutation in BnaC.FAD2.a introduced by TALE nuclease pair BnFAD2_T02
cctctcctccctcaccctctctcctacttcgcctggcctctctaccgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20622 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagccacgagtgcggccaccacgccttcagcgactaccagtggcttgacgacaccgtcggtctcatcttccactccttcctcctcgtcccttacttctcctggaagccgccggagtaggccttggtgtccacgatcacgccgtagtcatcgacgccaccattccaacactggctccctcgagagagacgaagtgtttgtccccaagaagaagtcagacatcaagtggtacggcaagtacctcaacaaccctttgggacgctccgttatgttaacggttcagttcactctcgcctggcctttgtacttag

SEQ ID NO: 20623 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20624 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagggatgaagtgttcgtccccaagaagaaatccgacatcaagtggtacggaaagtacctcaacaacccttggggacgcaccgtgatgttaacggttcagttcactctcggctggcctttgtacttag

SEQ ID NO: 20625 - DNA, 358 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 20626 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 20627 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20628 - DNA, 357 bp, Artificial
  Mutation in BnaC.FAD2.a introduced by TALE nuclease pair BnFAD2_T02
cctctcctccctcaccctctcccttacctcgcctggaccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctagccgcccagttcacgctcggctggcctttgtacttag

SEQ ID NO: 20629 - DNA, 360 bp, Artificial
  Mutation in BnaC.FAD2.a introduced by TALE nuclease pair BnFAD2_T02
cctctcatccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttctctctcggctgccctttgtacttag

SEQ ID NO: 20630 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgatagagacgaagtgtttgtccccaagaagaagtcagacatcaagtggtacggcaagtacctcaacaaccctttgggacgcaccgtgatgttaacggttcatttcactcgcggctggcctgtgtacttag

SEQ ID NO: 20631 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20632 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaagggttaaggtgactcgcgcgggccctttgtacttag

SEQ ID NO: 20633 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgcctggcctttgtacttag

SEQ ID NO: 20634 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtaagtgagtcacgttatgacccccgccgatgacgcgggacagtcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctgccctgtgtacttag

SEQ ID NO: 20635 - DNA, 363 bp, Artificial
  Mutation in BnaC.FAD2.a introduced by TALE nuclease pair BnFAD2_T02
cctctcctccctcaccctctctcctacttcgcctgccctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcgccgtgatgttaacggtgcagttcactcgcggctggcctgtgtacttag

SEQ ID NO: 20636 - DNA, 361 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaaaagccatcgacgccaccattccaacaccggatccctcgagaaggatgaagtgttcgtccccaagaagaaatccgacatcaagtggtacggaaagtacctcaacaacccgcgaggacgcacggggatgctaaccgtccattccacgctagcctggccttgtacttag

SEQ ID NO: 20637 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 20638 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctaaacaaccctgtgggacgcaccgtgatgttaacgtttcagttcactctcggctggcctttgtacttag

SEQ ID NO: 20639 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacatcaacaaccctttgggacgcaccgtgatgttaacggttcagttcactctcggctggcctttgtacttag

SEQ ID NO: 20640 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccttttggaacgcaccgggatgttaacggttcagttcacgctcggctgcccttagtacttag

SEQ ID NO: 20641 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 20642 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccttggggacgcaccgtgatgttaacgggtcagttcactcgtggctgcccttggtacttag

SEQ ID NO: 20643 - DNA, 358 bp, Artificial
  Mutation in BnaC.FAD2.a introduced by TALE nuclease pair BnFAD2_T02
cctctcctccctcaccctctctcctacttcgcctggcctctctacttggcctaccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20644 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20645 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcaccgtgatgttagcggttcagttcactctcggctggcctttgtacttag

SEQ ID NO: 20646 - DNA, 399 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagccgaagtttccaaaaggtcgttgatcaaagctcgccgcgttcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20647 - DNA, 358 bp, Artificial
  Mutation in BnaC.FAD2.a introduced by TALE nuclease pair BnFAD2_T02
cctctcctcactcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 20648 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgagtgcggccaccacgccttcagcgactaccagtggcttgacgacaccgtcggtctcatcttccactccttcctcctcgtcccttacttctcctggaagtaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20649 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcgtctggcctttgtacttag

SEQ ID NO: 20650 - DNA, 446 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatgttgccgctggaccagcggtggtttgtttgccggatcaagagctaccaactctttttccgaaggtaactggcttcagcagagcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20651 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactcctttctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtactta

SEQ ID NO: 20652 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcgggtgccctgtgtacgtag

SEQ ID NO: 20653 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20654 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaatactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20655 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactcgcggctggcctttgtacttag

SEQ ID NO: 20656 - DNA, 363 bp, Artificial
  Mutation in BnaC.FAD2.a introduced by TALE nuclease pair BnFAD2_T02
cctctcctccctcaccctctctcctacttcgcctggcctctccactgggcctgccaagggtgcgtcctaaccggcgtctgggtcatagcccacgagtgcggccaccacgccttcagcgactaccagtggcttgacgacaccgtcggtctcatcttccactccttcctcctcgtcccgtacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20657 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcattctcggctggcctttgtacttag

SEQ ID NO: 20658 - DNA, 360 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 20659 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 20660 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctattccaccattccaacactggctccctcgagagagacgaagtgtttgtccccaagaagaagtcagacatcaagtggtacggcaagtacctcaacaaccctttggtacgcaccgtgatgttaacggttcagttcactctcggctggcctttgtacttag

SEQ ID NO: 20661 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttcacgacaccgtcggtctcatcttccactccttcctcctcgtcccttacttctcctgttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20662 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgattttaacggttcaggtcactctcggctggcctttgtacttag

SEQ ID NO: 20663 - DNA, 442 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagcaggtggtggccatcgccagcaatggcggtggcaagcaggcgctggagacggtccagcggctgttgccggtgctgtgccaggcccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20664 - DNA, 319 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20665 - DNA, 357 bp, Artificial
  Mutation in BnaC.FAD2.a introduced by TALE nuclease pair BnFAD2_T02
cctctcctccctcaccctctcccttacctcgcctagcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20666 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20667 - DNA, 394 bp, Artificial
  Mutation in BnaC.FAD2.a introduced by TALE nuclease pair BnFAD2_T02
cctctcctccctcaccctctcccttacctcgcctgtcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgagtcacgttatgacccccgccgatgacgcgggacagtcatcgacgccaccattccaacactggctccctcgagagagacgaagtgtttgtccccaataagaagtcagacatcaagtggtacggcaagtacctcaacaaccctttgggacgcaccgtgatgttaacggttcaggtcactctcggctggccttggtacttag

SEQ ID NO: 20668 - DNA, 356 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccattgggacgcaccgtgatgttaacggttcagtgcacgctggggtggcctttgtacttag

SEQ ID NO: 20669 - DNA, 409 bp, Artificial
  Mutation in BnaC.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagcaacagccgctggaccgtctccagcgcctgcttgccgccatcgtggctggcgagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcccggctggcctgtgtacttag

SEQ ID NO: 20670 - DNA, 357 bp, Artificial
  Mutation in BnaC.FAD2.a introduced by TALE nuclease pair BnFAD2_T02
cctctcctccctcaccctctctcctacttcgcctgtcctctctactgggcctgccaagggagcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcagcaagcgtctgggacgcacaggggtgtgaacggttcgcttcactctcggctgccctttgtacttag

SEQ ID NO: 20671 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagttgtcatcgacgccaacattccaacactggctccctcgagagagacgaagtgtttgtccacaagaagaagtcagacatcaagtggtacggcaagtacctcaacaacccttggggacgcaccgtgatgttaacggttcagttcactctcggctggccttggtacttag

SEQ ID NO: 20672 - DNA, 340 bp, Artificial
  Mutation in BnaC.FAD2.a introduced by TALE nuclease pair BnFAD2_T02
ctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20673 - DNA, 370 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccaccagcaatattggtggcaagcaggcgctggagacagccatcgacgccaccattccaacactggctccctcgagagagacgaagtgtttgtccccaagaagaagtcagacatcaagtggtacggcaagtacctcaacaaccctttgggacgcaccgtgatgttaacggtgcatttcactctcggctggcctttgtacttag

SEQ ID NO: 20674 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctgtgtattag

SEQ ID NO: 20675 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcccggctggcctttgtacttag

SEQ ID NO: 20676 - DNA, 365 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaaccctgtgggacgctccgtgatgttaacggttcagttcactctcggctggcctttgtacttag

SEQ ID NO: 20677 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 20678 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccccttcctcctcgtcccttacttctcctggaagtcatcgacgccaccattctaacactggctccctcgagagagacgaagtgtttgtccccaagaagaagacagacatcaagtggtacggcaagtacctcaacaaccttttgggacgcaccgggatgttaacggttcagttcactcgcggctgccatttgtacttag

SEQ ID NO: 20679 - DNA, 356 bp, Artificial
  Mutation in BnaC.FAD2.a introduced by TALE nuclease pair BnFAD2_T02
cctctcctccctcaccctctcccttacctcgcctggcccctctaatgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttctctctcggctggcctttgtacttag

SEQ ID NO: 20680 - DNA, 356 bp, Artificial
  Mutation in BnaC.FAD2.a introduced by TALE nuclease pair BnFAD2_T02
cctctcctccctcaccctctctcctacttcgcctggcatctctcctgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcaccgacgccaccattccaacactggctccctcgagagagacgaagtgtttgtccccaagaagaagtcagacatcgagtggtacggcaagtacctcaacaaccctttgggacgcaccgggaggttaacggtgcatgtcactcgcggcgggcctgagtacttag

SEQ ID NO: 20681 - DNA, 407 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtacggtgctgttccgggcgatctcgatcagctcgatgtactcgtgggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20682 - DNA, 359 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagccatcgacgccaccattccaacaccggatccctcgagagggatgaagtgttcgtccccaagtagaagtcagacatcaagtggtacggcaagtacctcaacaaccctttgggacgcaccgtgatgttaacggttcagttcactctcggctggcctttgtacttag

SEQ ID NO: 20683 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagacatcgacgccaccattccaacactggctccctcgagagagacgaagtgtctgtccccaagaagaagccagacatcaaggggtacggcaagtccctcaacaaccctttgggacgcaccgggaggttaacggttcagttcactcgcggctggcctttttactag

SEQ ID NO: 20684 - DNA, 336 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacagccctgtgggacgcgccgtgatgttaacggttcagttcactctcggctggccgttgtacttag

SEQ ID NO: 20685 - DNA, 360 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 20686 - DNA, 355 bp, Artificial
  Mutation in BnaC.FAD2.a introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 20687 - DNA, 357 bp, Artificial
  Mutation in BnaC.FAD2.a introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggtgcagttcactctcggctggccttggtacttag

SEQ ID NO: 20688 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtgcagttcacgctcggctggccttagtacttag

SEQ ID NO: 20689 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20690 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcgccgggatgttaacggttcagttcactctcggctggcctttgtacttag

SEQ ID NO: 20691 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20692 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 20693 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 20694 - DNA, 318 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaagtagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20695 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgcattcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20696 - DNA, 451 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgcatgcatggcgcaatgcactgacgggtgccccgctcaacttgaccccaagattgcaaaacgtggcggcgtgaccgcagtggaggcagtgcatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20697 - DNA, 403 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcagtctcatcttccactccttcctcctcgtcccttacttctcctggaagcaagatcgcttggcctcgcgcgcagatcagttggaagaatttgtccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20698 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20699 - DNA, 306 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20700 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtggctccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgcacttag

SEQ ID NO: 20701 - DNA, 357 bp, Artificial
  Mutation in BnaC.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20702 - DNA, 357 bp, Artificial
  Mutation in BnaC.FAD2.a introduced by TALE nuclease pair BnFAD2_T02
cctctcctccctcaccctctctcctacttcgcctggcctatctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20703 - DNA, 357 bp, Artificial
  Mutation in BnaC.FAD2.a introduced by TALE nuclease pair BnFAD2_T02
cctctcctccctcaccctctccattacctcgcctggcccctctcctcagcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcacgctcggctggcctttgtacttag

SEQ ID NO: 20704 - DNA, 407 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacggtgctgttccgggcgatctcgatcagctcgatgtactcgtgggacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20705 - DNA, 356 bp, Artificial
  Mutation in BnaC.FAD2.a introduced by TALE nuclease pair BnFAD2_T02
cctctcctccctcaccctctctactacttcgcctggcctctctaatgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttggggcgcaccgtgatgttatcggttcatttctctctctgctggccgttggacttag

SEQ ID NO: 20706 - DNA, 379 bp, Artificial
  Mutation in BnaC.FAD2.a introduced by TALE nuclease pair BnFAD2_T02
cctctcctccctcaccctctctcctacttcgcctggcctctctactgggcccgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcgttcggctgcggcgagcggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20707 - DNA, 359 bp, Artificial
  Mutation in BnaC.FAD2.a introduced by TALE nuclease pair BnFAD2_T02
cctctcctccctcaccctgtctcctacttcgcctggcctctctcctgggcctgccaaggatgcgtcctaaccggcgtctgggtcatagcccacgagtgcggccaacacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtacccaagaagaagtcagacatcaagtggtacggcaagtacctcaacaaccctttgggacgcaccgtgatgttaacggttcagttcactctcggctggcctttgtacttag

SEQ ID NO: 20708 - DNA, 357 bp, Artificial
  Mutation in BnaC.FAD2.a introduced by TALE nuclease pair BnFAD2_T02
cctctcctccctcaccctctctactacttcgcctggcctctctaatgggcttgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctctgctggcctttgtacttag

SEQ ID NO: 20709 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 20710 - DNA, 357 bp, Artificial
  Mutation in BnaC.FAD2.a introduced by TALE nuclease pair BnFAD2_T02
cctctcctccctcaccctttatcctacttcgcctggcctatctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtctttgtccccaagaagaagtcagacatcaagtggtacggcaagtacctcaacaacccgttgggacgcaccgggatgttaacggttcagttcactctcggctggccattatacttag

SEQ ID NO: 20711 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 20712 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacgtag

SEQ ID NO: 20713 - DNA, 355 bp, Artificial
  Mutation in BnaC.FAD2.a introduced by TALE nuclease pair BnFAD2_T02
cctctcctccctcaccctctctcctccttcgcatggactctctacttgtactgcccagggtgcgtcctaaccggcgactgggtcatagcccacgagtgcggccaccacgacttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggctatattcgccacaagcgtctgatacgtatagtgatgataacgtttcagttcactctcggctggcctttgtacttag

SEQ ID NO: 20714 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 20715 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 20716 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 20717 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtaccgcaacaacccttggggacgcaccgtgatgttaacggttcagttcactctcggctggcctttgtacttag

SEQ ID NO: 20718 - DNA, 356 bp, Artificial
  Mutation in BnaC.FAD2.a introduced by TALE nuclease pair BnFAD2_T02
cctctcctccctcaccctctctcctacttcgcctggcctctctaatgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 20719 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20720 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcgacgccaccattccaacactggctccctcgagagagacgaagtgtttgtccccaagaagaagtcagacatcaagtggtacggcaagtacctcaacaaccttttgggacgcgccgtgatgttaacggttcagttcactcgcggcgggcctttgtacttag

SEQ ID NO: 20721 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggccttggtacttag

SEQ ID NO: 20722 - DNA, 355 bp, Artificial
  Mutation in BnaC.FAD2.a introduced by TALE nuclease pair BnFAD2_T02
cctctcctccatcaccctctcccttacctcgcctggccactctcctgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaaggacctcaacaaccctttgggacgcaccgggatgttaacggtgcagttcactcgcggctggccttagtacttag

SEQ ID NO: 20723 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctatgacgcacggtgatgctaaccgtccagttcacgctcggctgccctttgtacttag

SEQ ID NO: 20724 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgaggctaaccggccagttcacgctcggctggcctttgtacttag

SEQ ID NO: 20725 - DNA, 290 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20726 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcccttgtacttag

SEQ ID NO: 20727 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20728 - DNA, 370 bp, Artificial
  Mutation in BnaC.FAD2.a introduced by TALE nuclease pair BnFAD2_T02
cctctcctccctcaccctctctcctacttcgcctgcactctctactgggcctgccaagggtgcgtcctaaccggcgtctgggtcatagcccacgagtgcggccaccacgccttcagcgactaccagtggcttgacgacaccgtcggtctcatcttccactccttccaccaccagcaatattggtggcaagcaggcgctggagacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20729 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggaaagtacctcaacaacccgctaggacgcacggtgatactaaccgtccagttcacgcgcggctggcctttgtacttag

SEQ ID NO: 20730 - DNA, 357 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaacccgttgggacgcaccgtgatgttaacggttcatttcactctcggctggccttagtacttag

SEQ ID NO: 20731 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaaggcacgccaccattccaacactggctccctcgagagagacgaagtgtttgtccccaagaagaaggcagacatcaagtggtacggcaaggacctcaacaacccttggggacgcaccgtgatgttaacggtgcagttcactcgcggctggcctttgtacttag

SEQ ID NO: 20732 - DNA, 415 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatctcaactctcccgccaccgtgagcaaggcctccagagcgcgtgcgccggaccagtcatcgacgccaccattccaacactggctccctcgagagagacgaagtgtttgtccccaagaagaagccagacatcaagtggtacggcaagtacctcaacaaccctttgggacgcaccgtgatgttaacggttcagttcactctcggctggcctttgtacttag

SEQ ID NO: 20733 - DNA, 357 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20734 - DNA, 363 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20735 - DNA, 356 bp, Artificial
  Mutation in BnaC.FAD2.a introduced by TALE nuclease pair BnFAD2_T02
cctctcctccctcaccctctctcctacttcgcctggcctctctactgtgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 20736 - DNA, 455 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtaatagcccacgagtgcggccaccacgccttcagcgactaccagtggcttgacgacaccgtcggtctcatcttccactccttcctcctcgtcccttacttctcctggaagtccagcggctgttgcccccgccattgctggcgatggccaccccctgctggggggtcaagccgtgggcctggcacagcaccggcaacaggcgctggacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 20737 - DNA, 408 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatatttggattgagagtgaatatgagactctaattggatactgaggggaatttgtcatcgacgccaccattccaacactggctccctcgagagagacgaagtgttggtccccaagaagaagtcagacatcaagtggtacggcaagtacctcaacaaccctttgggacgcaccgtgatgttaacggttcagttcacgctcggctggcctttgtacttag

SEQ ID NO: 20738 - DNA, 392 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtgcattgcgcttaccagaggaaaactagaaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20739 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 20740 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacactcggctggcctttgtacttag

SEQ ID NO: 20741 - DNA, 357 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttccctctccgctggcctttggacttag

SEQ ID NO: 20742 - DNA, 310 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaacccgttgggacgcaccgtgatgttaacggttcagttcactctcggctggccttagcacttag

SEQ ID NO: 20743 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtaccccaaaacccctgtgggacgcaccgtgatgttaacggttcagttcactctcggctggcctttgtacttag

SEQ ID NO: 20744 - DNA, 359 bp, Artificial
  Mutation in BnaC.FAD2.a introduced by TALE nuclease pair BnFAD2_T02
cctctcctccctcaccctgtacgttacctcgcctggtccctccactgcgcctgccaaggctgcgtcctaacgggcctctgggtcatcgcccacgaatgtggccaccacgccttcagcgactaccagtggcttgacgaccccgtcggtctcatcttccactccttcctcctcgtcccttacttctcctggaaacagtcatcgacgccaccattccaacactggctccctcgagagagacgaagtgtttggccccaagaagaagtcagacatcaagtggtacggcatgtacctcaacatcgcttgggggctctccgtgatgttaacggttcagtgcacgctggggtggcccttgtacttag

SEQ ID NO: 20745 - DNA, 357 bp, Artificial
  Mutation in BnaC.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaggcagacatcaagtggtacggcaagtacctcaacaacccgttgggacgcaccgtgatgttaacggttcaggtcactctcggctggcctttgtacttag

SEQ ID NO: 20746 - DNA, 433 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtaacagcggctgttgccggtgctgtgccaggcccacggcttgaccccccgggcccgggatccgatccaatgctattaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20747 - DNA, 355 bp, Artificial
  Mutation in BnaC.FAD2.a introduced by TALE nuclease pair BnFAD2_T02
cctctcctccctcaccctctctcctacttcgcctggcctctctactgggcatgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20748 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20749 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 20750 - DNA, 355 bp, Artificial
  Mutation in BnaC.FAD2.a introduced by TALE nuclease pair BnFAD2_T02
cctctcctccctcaccctctctcctacttcgcctggcctctctaatgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 20751 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcaatggcggtggcaagcaggcgctggagacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20752 - DNA, 356 bp, Artificial
  Mutation in BnaC.FAD2.a introduced by TALE nuclease pair BnFAD2_T02
cctctcctccctcaccctgtatcctacttcgcctggcctctccactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcccggtgatgctacccgtccagttcacgctcggctggcctttgtacttag

SEQ ID NO: 20753 - DNA, 356 bp, Artificial
  Mutation in BnaC.FAD2.a introduced by TALE nuclease pair BnFAD2_T02
cctctcctccctcaccctctctcctacttcgcctggcctctctcatgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttatacttag

SEQ ID NO: 20754 - DNA, 357 bp, Artificial
  Mutation in BnaC.FAD2.a introduced by TALE nuclease pair BnFAD2_T02
cctctcctcccttaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20755 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 20756 - DNA, 354 bp, Artificial
  Mutation in BnaC.FAD2.a introduced by TALE nuclease pair BnFAD2_T02
cctctcctccctcaccctctctcctacttcgcctggcccctctcctcgacctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgctaggacgcacggtggttctaaccgtccaggtcacgctcggctggccttagtacttag

SEQ ID NO: 20757 - DNA, 359 bp, Artificial
  Mutation in BnaC.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20758 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagggacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20759 - DNA, 357 bp, Artificial
  Mutation in BnaC.FAD2.a introduced by TALE nuclease pair BnFAD2_T02
cctctcctccctcaccctctatactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccattacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20760 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacatcaagtggtacggaaagtacctcaacaaccctttgggacgcaccgtgatgttaacggttcagttcactctcggctggcctttgtacttag

SEQ ID NO: 20761 - DNA, 336 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctcccgcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20762 - DNA, 352 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttgcttctccagtcatcgacgccaccattccaacactggctccctcgagagagacgaagtgtttgtccccaagaagaagtcagacatcaagtggtacggcaagtacctcaacaaccccttgggacgcaccgtgatgttaacggttcagttcactctcggctggccgttgtacttag

SEQ ID NO: 20763 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtaccgcaacagccctttgggacgcaccgtgatgttaacggttcagttcactctcggctggcctttgtacttag

SEQ ID NO: 20764 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 20765 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctgtgggacgcaccgtaatgttaacggttcagttctctctcggctggcctttgtacttag

SEQ ID NO: 20766 - DNA, 362 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20767 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 20768 - DNA, 411 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacagagcgaggtatgtaggcggtgctacagagttcttgaagtggtggcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20769 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 20770 - DNA, 356 bp, Artificial
  Mutation in BnaC.FAD2.a introduced by TALE nuclease pair BnFAD2_T02
cctctcctccctcaccctctctcctacttcgcctggcctctctcctgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacactggctccctcgagagagacgaagggtttgtccccaagaagaagtcagacatcaagtggtacggcaagtacctcaacaaccctttgggacgcaccgtgatgttaacggttcaggtcactctcggctggcctttgtacttag

SEQ ID NO: 20771 - DNA, 310 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttctctctctgctggcctttgtacttag

SEQ ID NO: 20772 - DNA, 357 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 20773 - DNA, 455 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgacggtccagcgcctgcttgccggtgctgtgccaggcccacggcttgaccccccagcaggtggtggccatcgccagcaatggcggtggcaagcaggcgctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20774 - DNA, 443 bp, Artificial
  Mutation in BnaC.FAD2.a introduced by TALE nuclease pair BnFAD2_T02
cctctcctccctcaccctctcccttacctcgcctggaccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaggcgatggccaccacctgctccggggtcaagccgtgggcctggcacagcaccggcaacagcgcctgcaccgtctccagcgcctagtcatcgacgccaccattccaacactggctccctcgagagagacgaagtgtttgtccccaagaagaagtcagacatcaagtggtacggcaagtacctcaacaaccgttggggacgcaccggggtgtgaacggttcagtgcgctctcggctggcctttgtacttag

SEQ ID NO: 20775 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaataaccctttgggacgcaccgtgatgttaacggttcagttcactctcggctggcctttgtacttag

SEQ ID NO: 20776 - DNA, 356 bp, Artificial
  Mutation in BnaC.FAD2.a introduced by TALE nuclease pair BnFAD2_T02
cctctcctccctcaccctctctcctacttcgcctggcctctctaatgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggccttggtacttag

SEQ ID NO: 20777 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagctcacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20778 - DNA, 439 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccggtgctgtgccaggcccacggcttgaccccggagcaggtggtggccatcgccagccacgatggcggcaagcaggcgcagtcatcgacgccaccattccaacactggctccctcgagagagacgaagtgtttgtccccaagaagaaatccgacatcaagtggtacggaaagtacctcaacaacccgctaggacgcacggtgatgctaaccgtccaggtcacgctcggctggccgttgtacttag

SEQ ID NO: 20779 - DNA, 389 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatagcccacgagtgcggccaccacgccttcagcgactaccagtggcttgacgacaccgtcggtctcatcttccactccttcctcctcatcccttacttctcctggaagtctggcgccgtcgggcttcctggagccgcccagccatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 20780 - DNA, 409 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgccccttacttctcctggaaccttgaccgaacgcagcggtggtaacggcgcagtggcggttttcatggcttgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20781 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtctccaagaagaaatccgacatcaagtggtacggaaagtacctcaacaacccgctaggacgcacggtgatgctaaccgtccagttcacgctcggctggcctttgtacttag

SEQ ID NO: 20782 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggccgttgtacttag

SEQ ID NO: 20783 - DNA, 355 bp, Artificial
  Mutation in BnaC.FAD2.a introduced by TALE nuclease pair BnFAD2_T02
cctctcctccctcaccctctatcctacttcgcctggcccctcccctgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaataagaagtcagacatcgagtggtacggcaagtacctcagcaagcctcagagacgcatcgtggtctgaaccgcccagttcaccctcggctggcctttgtacttag

SEQ ID NO: 20784 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggttcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20785 - DNA, 354 bp, Artificial
  Mutation in BnaC.FAD2.a introduced by TALE nuclease pair BnFAD2_T02
cctctcctccctcaccctatcccttacctcgcctgccccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20786 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcataaccggcgtctgggtcatagcccacgagtgcggccaccacgccttcagcgactaccagtggctggacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20787 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctgtgggacgcaccgtgatgttaactgtgcagttcactctcggctggcctttgtacttag

SEQ ID NO: 20788 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20789 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 20790 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 20791 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagtccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgaggttaacggttcagttcactctcggctggccgttgtacttag

SEQ ID NO: 20792 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttggaacgcaccgtgatgttaacgtttcaggtcactctcggctggcctgtgtacttag

SEQ ID NO: 20793 - DNA, 322 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20794 - DNA, 291 bp, Artificial
  Mutation in BnaC.FAD2.a introduced by TALE nuclease pair BnFAD2_T02
cctctcctccctcaccctatctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgtgaacggttcagttcactctcggctggcctttgtacttag

SEQ ID NO: 20795 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 20796 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 20797 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 20798 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 20799 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 20800 - DNA, 348 bp, Artificial
  Mutation in BnaC.FAD2.a introduced by TALE nuclease pair BnFAD2_T02
cctctcctccctcaccctctctcctacttcgcctcgcctctctactgggcctgccaagggtgcgtcctaaccggcgtctgggtcatagcccccgagtgcggccaccacgccttcagcgactaccagtggctggacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgagccgtgatgttaacggttcagtgcactctcggctggcctttgtacttag

SEQ ID NO: 20801 - DNA, 359 bp, Artificial
  Mutation in BnaC.FAD2.a introduced by TALE nuclease pair BnFAD2_T02
cctctcctccctcaccctgtttcctacttcgcctgtcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtaccgcagcagccctgtgggacgcgccgggtggttaacagttcagtgctctcgcggctggccgtggtacttag

SEQ ID NO: 20802 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgttcgtccccaagaagaaatccgacatcaagtggtacggaaagtacctcaacaacctgctaggacgaacggtgatgctaaccgtgcaggtcacgctcggctggcctttgtacttag

SEQ ID NO: 20803 - DNA, 409 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagcaacagccgctggaccgtctccagcgcctgcttgccgccatcgtggctggcgagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20804 - DNA, 357 bp, Artificial
  Mutation in BnaC.FAD2.a introduced by TALE nuclease pair BnFAD2_T02
cctctcctccctcaccctctctcctacttcgcctggccactctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20805 - DNA, 355 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 20806 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20807 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttctactccttcctcctcgtcccttacttctcctggaagagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20808 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgggctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20809 - DNA, 363 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20810 - DNA, 356 bp, Artificial
  Mutation in BnaC.FAD2.a introduced by TALE nuclease pair BnFAD2_T02
cctctcctccctcaccctatctactacttcgcctggcctcaccactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 20811 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20812 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgtgtcctaaccggcgtctgggtcatagcccacgagtgcggccaccacgccttcagcgactaccagtggcttgacgacaccgtcggtctcatcttccactccttcctcctcgtcccttacttctcctgcaatggcggtggcaagcaggcgctggagacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20813 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 20814 - DNA, 342 bp, Artificial
  Mutation in BnaC.FAD2.a introduced by TALE nuclease pair BnFAD2_T02
cctctactccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacaaccctgtgggacgcaccgtgatgttaacggttcaggtcactctcggctggctgttgtacttag

SEQ ID NO: 20815 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtgcttag

SEQ ID NO: 20816 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctctgggacgcaccgtgatgttaaccgttcagttcacgctcggctggcctttgtacttag

SEQ ID NO: 20817 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 20818 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtctgtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20819 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgatctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgtgacgcaccgtgaggttaacggttcagttcactctcggctggcctttgtacttag

SEQ ID NO: 20820 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtaccccaacaaccctttgggacgcaccgtgatgttaacggttcagttcactctcggctggcctttgtacttag

SEQ ID NO: 20821 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagaggtacggcaagtacctcaacaaccctgtgggacgcaccgtgatgttaacggttcagttcactctcggctggcctttgtacttag

SEQ ID NO: 20822 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacatgcctgtgggacgcaccgtgatgttaacggttcaggtcactctcggctggcctttgtacttag

SEQ ID NO: 20823 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccacctttccaaccctggctccctcgcgagagactaagtgtttgtccccaagatgaattcggacatcaactggttcggcaagtacctcaacaaccctttgggacgcaccgtgatgttaacggttcagttcactctcggctggcctttgtacttag

SEQ ID NO: 20824 - DNA, 352 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20825 - DNA, 451 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtgagcatttttgacaagaaatatttgctagctgatagtgaccttaggcgacttttgaatacgctacttgcattacagcttacgaaccgaacaggcttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20826 - DNA, 341 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20827 - DNA, 412 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20828 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctcaccggcgtctgggtcatcgcccacgcgtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtcccaaagaagaagtcagacatcaagtggtaaggcaaggaccgcaacaaccctttgggacgcaccgtgatgttaacggttcagttcactctcggctggcctttgtacgtag

SEQ ID NO: 20829 - DNA, 462 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgtctccagcgcctgcttgccgccatcgtggctggcgatggccaccacctgctccggggtcacgccgtgggcctggcacagccccggcaacagccgctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctgtgtacttag

SEQ ID NO: 20830 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcactgtgatgttaacggttcagttcactctcggctggcctttgtacttag

SEQ ID NO: 20831 - DNA, 336 bp, Artificial
  Mutation in BnaC.FAD2.a introduced by TALE nuclease pair BnFAD2_T02
cctctcctccctcaccctctctcctacttctcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtccggcaagtaccccaacaaccctgtgggacgtaaggtgatgttaacggttcagttccctctcggctggcctttgtacttag

SEQ ID NO: 20832 - DNA, 311 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgtctttgtccccaagaagaaatccgacatcaagtggtacggaaagtacctcaacaacccgctaggacgcacggtgatgctaaccgtccagttcacgctcggctggcctttgtacttag

SEQ ID NO: 20833 - DNA, 352 bp, Artificial
  Mutation in BnaC.FAD2.a introduced by TALE nuclease pair BnFAD2_T02
cctctcccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20834 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgccattgctggcgatggccaccacctgctggggggtcagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20835 - DNA, 302 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtcttag

SEQ ID NO: 20836 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactgactccctcgagagagacgaagtgtttgtccccaagaagaagtcagacatcaagtggtacggcaagtacctcaacaaccctttgggacgcaccgtgatgttaactgttcagttcactctcggctggcctttgtacttag

SEQ ID NO: 20837 - DNA, 351 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctgcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 20838 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20839 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20840 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20841 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtaagacatcaagtggtacggcaagtacctcaacaaccctttgggacgcaccgtgatgttaacggttcagttcactctcggctggcctttgtacttag

SEQ ID NO: 20842 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20843 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgactacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20844 - DNA, 455 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaccgtctccagcgcctgcttgccaccattattgctggcgatggccaccacctgctggggggtcaagccgtgggcctggcacagcaccggcaacagccgcttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 20845 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgactaccagtggcttgacgacaccgtcggtctcatcttccactccttcctcctcgtcccttacttctcctggatcgacgccaccattccaatactggctccctcgagagagacgaagtgtttgtccccaagaagaagtcagacatcaagtggtacggcaagtacctcaacaaccctttgggacgcaccgtgatgttaacgattcagttcactctcggctggccgttgtacttag

SEQ ID NO: 20846 - DNA, 359 bp, Artificial
  Mutation in BnaC.FAD2.a introduced by TALE nuclease pair BnFAD2_T02
cctctcctccctcaccctctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctgtgtacttag

SEQ ID NO: 20847 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgttccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20848 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20849 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagtgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20850 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatggtaactgttcagtgcactctcggctggcctttgtactgag

SEQ ID NO: 20851 - DNA, 348 bp, Artificial
  Mutation in BnaC.FAD2.a introduced by TALE nuclease pair BnFAD2_T02
cctctcctccctcaccctctctcctacttcgtctggcctctctactgtgcttgacacgtgtgcgacctcaccggcgtctgggccatagcccacgagggcggccaccacgacttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaactcgtaccgcatctacctcaacaaccgttgtgtacgaactgtagtgttaacgcttcagttcactctcggctggcctttgtacttag

SEQ ID NO: 20852 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtctcacatcaagtggtacggcaagtacctcaacaaccctttgggacgcaccgtgatgttaacggttcagttcactctcggctggcctttgtacttag

SEQ ID NO: 20853 - DNA, 454 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgacggtccagcggctgtttccggtgctgtgccaggcccacggcttgaccccccagcaggtggtggccatcgccagcaatggcggtggcaagcaggcgctggagtcatcgacgccaccattccaacactggctccctcgagagagacgaagtgtttgtccccaagaagaagtcagacatcaagtggtacggcaagtacctcagcaaccctttgggacgcaccgtgaggttaacgtttcggttcactctcggctggcctttgtacttag

SEQ ID NO: 20854 - DNA, 352 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctggttcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20855 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20856 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggcgggcctttgtacttag

SEQ ID NO: 20857 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaaccgtccagttcactctcggctggcctttgtacttag

SEQ ID NO: 20858 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacacccctttgggacgcaccgtgatgttaacggttcagttccctctcggctggcctttgtacttag

SEQ ID NO: 20859 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 20860 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctaaacaaccctttgggacgcaccgtgatgttaacggttcagttcactctcggctggcctttgtacttag

SEQ ID NO: 20861 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 20862 - DNA, 427 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggtcaagccgtgggcctggcacagcaccggcaacagccgctggaccgtctccagcgcctgcttgcacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacgtag

SEQ ID NO: 20863 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcgccgtgatgttaacggtgcagttcactctcggctggcctttgtacttag

SEQ ID NO: 20864 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 20865 - DNA, 345 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20866 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgccctaacgggcctctgggtcatcgcccacgaatgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctgtggtacgcaccgtgatgttaacggttcagtgcactctcggctggcctttgtacttag

SEQ ID NO: 20867 - DNA, 347 bp, Artificial
  Mutation in BnaC.FAD2.a introduced by TALE nuclease pair BnFAD2_T02
gctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20868 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 20869 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaaatccgacatcaagtggtacggaaagtacctcaacaacccgctagtacgcacggtgatgctaaccgtccagttcacgctcggctggcctttgtacttag

SEQ ID NO: 20870 - DNA, 322 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggcaagtacctcaacaaccctttgggacgcaccgtgatgttaacggtccagttcacgctcggctggcctttgtacttag

SEQ ID NO: 20871 - DNA, 357 bp, Artificial
  Mutation in BnaC.FAD2.a introduced by TALE nuclease pair BnFAD2_T02
cctctcctccctcaccctctctcctacttagcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20872 - DNA, 343 bp, Artificial
  Mutation in BnaC.FAD2.a introduced by TALE nuclease pair BnFAD2_T02
cctctcctccctcaccctctcccttacctcgcctggccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20873 - DNA, 422 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20874 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20875 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgtcttcagcgactaccagtggcttgacgacaccgtcggtctcatcttccactccttcctcctcgtcccttacttctccttgaagggcatcgacgccaccattccaacactggctccctcgagagagacgaagtgtttgtccccaagaagaagacagacagcaagtggtacggaaagtacctcaacaacccgctaggacgcacggtgatgctaaccgtccagttcacgatcggctggccgttgtacgtag

SEQ ID NO: 20876 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 20877 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 20878 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacgacaagtacctcaacaacccgttgggacgcaccgtgatgttaacggttcagttcactctcggctggccggtgtacttag

SEQ ID NO: 20879 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggcttggcctttgtacttag

SEQ ID NO: 20880 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagcacctcaacaaccctttgggacgcaccgtgatgttaacggttcagttcactctcggctggcctttgtacttag

SEQ ID NO: 20881 - DNA, 357 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacgaaaagtacctcaacaacccgctaggacgcacggtgatgctaaccgtccagtgcacgctcggctgtcctttgtgcctag

SEQ ID NO: 20882 - DNA, 354 bp, Artificial
  Mutation in BnaC.FAD2.a introduced by TALE nuclease pair BnFAD2_T02
cctctcctccctcaccctctctcctacttcgcctggcctctctactgtgcctgccaagggtgcgtcctaaccggcgtctgggtcatagcccacgagtgcggccaccacgccttcagcgactaccagttgcttgacgacaccgtcggtctcatcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20883 - DNA, 357 bp, Artificial
  Mutation in BnaC.FAD2.a introduced by TALE nuclease pair BnFAD2_T02
cctctcctccctcaccctctctcctacttcgcctggcctctctaccgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20884 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20885 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcaatggcgatggcaagcaggcgctggagacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 20886 - DNA, 427 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctccagcgcctgcttgccaccattattgctggcgatggccaccacctgctgggggtcaagccgtgggcctggcacagcacctggacgccaccattccaacactggctccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 20887 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacgtcaagtaccgcaacaacccttggggacgcgccgtgatgttaacggttcatttcgctctcggctggcctgtgtacttag

SEQ ID NO: 20888 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgcgtcatagcccacgagtgcggccaccacgccttcagcgactaccagtggcttgacgccaccgtcggcctcctcttccactccttcctcctcgtcccttacttctcctggaaggtcatcgacgccaccattccaacactggcgccctcgagagagacgaagtgtttgtccccaagaagaagtcacacatcaagtggtacggcaagtacctcaacaaccctttgggacgcaccgtgatgttaacggttcagttcactctcggccggcctttgtacttag

SEQ ID NO: 20889 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaggtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20890 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccctcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20891 - DNA, 439 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccggtgctgtgccaggcccacggcttgaccccggagcaggtggtggccatcgccagccacgatggcggcaagcaggcgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20892 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcacaagtcatcgacgccaccattccaacactggctccctcgagagagacgaagtgtttgtccccaagaagaagtcagacatcaagtggtacggcaagtacctcaacagccctgtgggacgcaccgtgaggttaacggtgcagttcactctcggcgggccgttgtacttag

SEQ ID NO: 20893 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgacttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctgtgggacgcaccgtgatggtaacggttcaggtcactctcggcgggccgttgtacttag

SEQ ID NO: 20894 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctgcctttgtacttag

SEQ ID NO: 20895 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccatgggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 20896 - DNA, 340 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagatatcaagtggtacggcaagtacctcaacaaccctttgggacgcaccgtgatgttaacggttcagttcactctcggctggcctttgtacttag

SEQ ID NO: 20897 - DNA, 339 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccaccattccaacaccggatccctcgatagggacgaagtgttcgtccccaagaagaagtcagacatcaagtggtacggcaagtacctcaacaaccctttgggacgcaccgtgatgttaacggttcaggtcactcgcggctggctttggtacttg

SEQ ID NO: 20898 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacagcaagtggtacggcaagtacctcaacaaccctttgggacgcaccgtgatgttaacggttcagttcactctcggctggccttgtacgtag

SEQ ID NO: 20899 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20900 - DNA, 355 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaattacctcaacaaccctttggaacgcaccgtgatgttaacggttcagttcactctcggctgccctctgtgcttag

SEQ ID NO: 20901 - DNA, 356 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttgcttctcctggaagtcatcgacgccaccattccaacactggctccctcgagagagacgaagtgtttgtccccaagaagaagtcaaacatcaagtggtacggcaagtacctcaacaacccgttgggacgcaccgtgatgttaacgtttcagttcactcgcggctggccattgtacttag

SEQ ID NO: 20902 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20903 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtcccccaacaaccctttgggacgcaccgtgatgttaaccgttcagttcactctcggctggcctttgtacttag

SEQ ID NO: 20904 - DNA, 354 bp, Artificial
  Mutation in BnaC.FAD2.a introduced by TALE nuclease pair BnFAD2_T02
cctctcctccctcaccctctctcctacttcgcctggcctctgtactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttgagttcactctcggctggcctttgtacttag

SEQ ID NO: 20905 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20906 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 20907 - DNA, 421 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacattgctggcgatggccaccacctgctggggggtcaagccgtgggcctggcacagcaccaccaccagcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20908 - DNA, 319 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20909 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacaccggatccctcgagagggatgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 20910 - DNA, 352 bp, Artificial
  Mutation in BnaC.FAD2.a introduced by TALE nuclease pair BnFAD2_T02
cctctcctcactcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaacgtgatgttaacggttcagttcactctcggctggcctttgtacttag

SEQ ID NO: 20911 - DNA, 356 bp, Artificial
  Mutation in BnaC.FAD2.a introduced by TALE nuclease pair BnFAD2_T02
cctctcctccctcaccctctctcctacttcgcctgccctctctactgggcctgccaagggtgcgtcctaaccggcgtctgggtcatagcccacgagtgcggccaccacgccttcagcgactaccagtggcttgacgacaccgtcagtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20912 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcacgctcggctggcctttgtacttag

SEQ ID NO: 20913 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 20914 - DNA, 363 bp, Artificial
  Mutation in BnaC.FAD2.a introduced by TALE nuclease pair BnFAD2_T02
cctctcctccctcaccccctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20915 - DNA, 422 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtgacttgacgacaccgtcggtctcatcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20916 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttatacttag

SEQ ID NO: 20917 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggccgttgtacttag

SEQ ID NO: 20918 - DNA, 291 bp, Artificial
  Mutation in BnaC.FAD2.a introduced by TALE nuclease pair BnFAD2_T02
cctctcatccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20919 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtactgcaagtacctcaacaaccctttgggacgcaccgtgatgttaacggttcagttcactctcggctggcctttgtacttag

SEQ ID NO: 20920 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtgggacggcaagtacctcaacagcccgttgggactcaccgtgatgttaacggttcagtgcactctcggctggcctgggtacttag

SEQ ID NO: 20921 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20922 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggccgttgtacttag

SEQ ID NO: 20923 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccttggggacgcagcgtgatgttaacggttcagttcactctcggctggcctttgtacttag

SEQ ID NO: 20924 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcgtcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcttgcctttgtacttag

SEQ ID NO: 20925 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccaggaagttcatcgacgccaccattccaacactggctccctcgagagagacgaagtgtttgtccccaagaagaaatcagacatcaagtggtacggcaagtaccgcaacaacccttagagacgcaccgtgatgttaaccggtcagtactctctcggctggcctttgtacttag

SEQ ID NO: 20926 - DNA, 406 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtactccagcgcctgcttgccaccattattgctggcgatggccaccacctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20927 - DNA, 408 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccggtgctgtgccaggcccacggcttgaccccccagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20928 - DNA, 439 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccggtgctgtgccaggcccacggcttgacccctgagcaggtggtggccatcgccagccacgatggcggcaagcaggcgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20929 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 20930 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagccatcgacgccaccattccaacaccggatccctcgagagggatgaagtgttcgtccccaagaagaagtcagacatcaagtggtacggcaagtacctcaacaaccctttgggacgcaccgtgaggttaacggttcagttcactctcggctggcctttgtacttag

SEQ ID NO: 20931 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 20932 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacaaccctttgggacgcaccatgatgttaacggttcagttcactctcggctggcctttgtacttag

SEQ ID NO: 20933 - DNA, 319 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaacccgttgggacgcacggtgatgctaaccgtccagttcacgcgcggctggcctttgtacttag

SEQ ID NO: 20934 - DNA, 412 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctattattattccaccaggtggtggccatcgccagcaataatggtggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20935 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggcagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20936 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctagtcccttacttctcctggaacagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 20937 - DNA, 366 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtcgactctcggctggccgttgtacttag

SEQ ID NO: 20938 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttggttgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20939 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctgtgggacgcaccgtgatgttaaccgttcagttcactctcggctggcctttgtacttag

SEQ ID NO: 20940 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20941 - DNA, 349 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcggctaccagtggcttgacgacaccgtcggtctcatcatccactccttcctcctcgtcccttacttccgtcatcgacgccaccattccaacactggctccctcgagagagacgaagtgtttgtccccaagaagaagtcagacatcaagtggtacggaaagtacctcaacaacccgctaggacgcacggtgatgctaaccgaccagtccacgctcggctggccgttgtacttag

SEQ ID NO: 20942 - DNA, 387 bp, Artificial
  Mutation in BnaC.FAD2.a introduced by TALE nuclease pair BnFAD2_T02
cctctcctccctcaccctctctcctacttcgcctggcctctctactgggcctaccaagggtgcgtcctaaccggcgtctgggtcatagcccacgagtgcggccaccacgccttcagcgactaccagtggcttgacgacaccgtcggtctcatcttccactccttcctcctcgtcccttacttctcctgggcctggcacagcaccggcaacagccgctggacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20943 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaatggttcagttcactctcggctggcctttgtacttag

SEQ ID NO: 20944 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgtggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20945 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtcatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttcg

SEQ ID NO: 20946 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaaggacctcaacaacccgttgggacgcaccgggatgttaacgtttcagttcactctcggctggcctttgtacttag

SEQ ID NO: 20947 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20948 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgacttag

SEQ ID NO: 20949 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20950 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggcttgacgacaccgtcggtctcatcttccactccttcctcctcgtcccttacttctcctattccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20951 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccatcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 20952 - DNA, 290 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaaatccgacatcaagtggtacggaaagtacctcaacaacccgctaggacgcacggtgatgctaaccgtccagttcacgctcggctggcctttgtactta

SEQ ID NO: 20953 - DNA, 388 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagccttctgcttagtttgatgcctggcagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20954 - DNA, 445 bp, Artificial
  Mutation in BnaC.FAD2.a introduced by TALE nuclease pair BnFAD2_T02
cctctcctccctcaccctctcccttacctcgcctggcccccctactgggcctgccaaggctgcgtcctaacgggcctctgggtcatcgcccacgaatgcggccaccacgccttcagcgaccaccagtggcttgacaacaccgtcggtctcatcttccactccttcctcctcgtcccttacttctcctggaagtatgttgccgctggaccagggtggtttgtttgccggatcaagagctaccaactctttttccgaaggtaactggcttcagcagagcacagtcatcgacgccaccattccaacactggctccctcgagagagacgaagtgtttgtccccaagaagaagtcagacatcaagtggtacggcaggtagctcaccacccctgtgggacgcacggtgaagttaccggttcagttccctctcggctggcctttgtacttag

SEQ ID NO: 20955 - DNA, 318 bp, Artificial
  Mutation in BnaC.FAD2.a introduced by TALE nuclease pair BnFAD2_T02
cctctcctccctcaccctctctcctacttcgcctggccactctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctgtgggacgcaccgtgaggttaacggttcagttcactctcggctggcctttgtacttag

SEQ ID NO: 20956 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagaggtacggcaagtacctcaacaaccctttgggacgcaccgtgatgttaacggttcagttcactctcggctggcctttgtacttag

SEQ ID NO: 20957 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 20958 - DNA, 358 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 20959 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20960 - DNA, 347 bp, Artificial
  Mutation in BnaC.FAD2.a introduced by TALE nuclease pair BnFAD2_T02
cctctcctccctcaccctctcccttacctcgcctggcccctctactgggcctaccaaggctgcgtcctaacgggcctctgggtcatcgcccacgaatgcggccaccacgccttcagcgaccaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20961 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggcctttgtacttag

SEQ ID NO: 20962 - DNA, 358 bp, Artificial
  Mutation in BnaC.FAD2.a introduced by TALE nuclease pair BnFAD2_T02
cctctcctccccaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20963 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20964 - DNA, 396 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcaatttgttgcaacgaacaggtcactatcagtcaaaacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 20965 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20966 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtattacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggcgggcctttgtacgtag

SEQ ID NO: 20967 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 20968 - DNA, 362 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20969 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggccatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtaccgcaacaaccctttgggacgcaccgtgatgttaacggttcagttcgctctcggctggccgttgtacttag

SEQ ID NO: 20970 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggattgacgacaccgtcggtctcatcttccactccttcctcctcgtcccttacttctcctggaacagtcatcgacgccaccattccaacactggctccctcgagagagacgaagtgtttgtccccaagaagaaggcagacatcaagtggtacggcaagtacctcaacagcccgttgggacgcgccgtgaggttaacggttcagttgactttcggctggccttggtacttag

SEQ ID NO: 20971 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaacccgtggggacgtacggtgatgttaacggttcagtgcactctcggctggcctttgtacttag

SEQ ID NO: 20972 - DNA, 356 bp, Artificial
  Mutation in BnaC.FAD2.a introduced by TALE nuclease pair BnFAD2_T02
cctctcctccctcaccctctctcctacttcgcctggcccctctactcggcctgccaagggtgcgccctaaccggcgtctgggtcatagcccacgagtgcggccaccccgccttcagcgactaccagtggcttgacgacaccgtcggcctcatcttccactccttcctcctcgtcccttacttctcctggaagtcatcgacgccaccattcccaccctcgctccctcgagagagacgaagtgttcgtccccaagaagaaatccgacatcaagtggtacggaaactacctcaacatcccgctaggccgcacggtgatgctaaccgtccaggtgacgctcggctggccttagtacttag

SEQ ID NO: 20973 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 20974 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 20975 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20976 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagttatcgacgccaccattccaacactggctccctcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 20977 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgacttag

SEQ ID NO: 20978 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacatccctttgggacgccccgtgatgttaacggttcagttcactctcggctggcctttgtacttag

SEQ ID NO: 20979 - DNA, 341 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgaggttaacggttcagttgactctcggctggcctttgtacttag

SEQ ID NO: 20980 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 20981 - DNA, 323 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgctcgccgcagccgaacgaccgagaagaagtcagacatcaagtggtacggaaagtacctcaacaacccgctaggacgcacggtgatgctaaccgtccagttcacgctcggctggcctttgtacttag

SEQ ID NO: 20982 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggtcaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatgaagtggtacggcaagtacctcaacaaccctttggggcgcaccgtgaagtaaacggttgagttcactctcggctagcctttgtacttag

SEQ ID NO: 20983 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgaaagagacgaagtgtttgtccccaagaagaagtcagacatcgagtggtacggcaagtacctcaacaacccgttgggacgccccgggatgttaacggttcagttcacttgcggctgccctgagtacttag

SEQ ID NO: 20984 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacagccctttgggacgcaccgggatgttaacggttcagttcactctcggctggcctgtgtacttag

SEQ ID NO: 20985 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctgtgtacttag

SEQ ID NO: 20986 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 20987 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagttgtacggcaagtacctcaacaaccctttgggacgcaccgtgatgttaacggttcagttcactctcggctggcctttgtacttag

SEQ ID NO: 20988 - DNA, 467 bp, Artificial
  Mutation in BnaC.FAD2.a introduced by TALE nuclease pair BnFAD2_T02
cctctcctccctcaccttctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggaaagcgggcagtgagcgcaacgcaattaagctcgccgcgttgtttcatcaagccttacggtcaccgtaaccagcaaatcaatatcactgtgtggctccaggccgccagtcatcgacgccaccattccaacactggctccctcgagagagacgaagtgtttgtccccaagaagaagtcagacatcaagtggtacggcaagtacctcaacaacccgctaggacgcacggtgaggctaaccgtccagttcacgctcggctggcctttgtacttag

SEQ ID NO: 20989 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20990 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 20991 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20992 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtattacagtcatcgacgccaccattccaacactggctccctcgagagagacgaagtgtttgtccccaagaagaagtcagacatcaagtggtacgacaagtacctcaacaaccctttgggacgcaccgggaggttaacggttcagttcactctcggctggcctttgtacttag

SEQ ID NO: 20993 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 20994 - DNA, 362 bp, Artificial
  Mutation in BnaC.FAD2.a introduced by TALE nuclease pair BnFAD2_T02
cctctcctccctcaacctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacagccctgtgggacgcaccgtgatgttaacggtttagtgcactctcggctggcctttgtacttag

SEQ ID NO: 20995 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctggatcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20996 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccactagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 20997 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcagcatcccttggggacgcaccgtgatgttaacggtttagttcactctcggctggcctttgtacttag

SEQ ID NO: 20998 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggatcatcgacgccaccattccaacactggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 20999 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21000 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttgactcgcggctggcctttgtacttag

SEQ ID NO: 21001 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcatcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21002 - DNA, 356 bp, Artificial
  Mutation in BnaC.FAD2.a introduced by TALE nuclease pair BnFAD2_T02
cctctcctccctcaccctctctcctacttcgcctggcatctctactaggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacactggctccctcgagagagacgaagtgtttgtccccaagaagaagtcagacatcaagtggtacggcaagtacctcaacaacccgttgggacgcaccgggatgttaacgtttgagttcacgctcggctggcctgtgtacttag

SEQ ID NO: 21003 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21004 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagtccacgagtgcgaccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21005 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgccctaaccggcgtctgggtcatagcccacgagtgcggccaccacgccttcagcgactaccagtggcttgacgacaccgtcggtctcctcttccactccttcctccacgtcccttacttctcctggaagtcatcgacgccaccattccaacactggctccctcgagagagacgaagtgtttgtccccaagaagaagtcagacatcaagtggtacggcaagtaccccaacacccctttgggacgcaccaggaggttacccgttcagttcactctcggctggcctttgtacttag

SEQ ID NO: 21006 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 21007 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctgtgggacgcaccgtgaggttaacggttcagttcactctcggctggccgttgtacttag

SEQ ID NO: 21008 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaacccgctaggacgcacggtgatgctaaccgtccatttcactctcggctggcctgtgtacttag

SEQ ID NO: 21009 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgtgtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21010 - DNA, 331 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacaatggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21011 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 21012 - DNA, 362 bp, Artificial
  Mutation in BnaC.FAD2.a introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacagccctgtgggacgcaccgtgatgttaacggttcagttcactctcggctggcctttgtacttag

SEQ ID NO: 21013 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggcaagtacctcagcaacccttggggacgcgccgtggtgttagctgttcagttcactctcggctggcctttgtacttag

SEQ ID NO: 21014 - DNA, 403 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagcaagatcgcttgtcctcgcgcgcagatcagttggaagaatttgtccgtcatcgacgccaccattccaacactggctccctcgagagagacgaagtgtttgcccccaagaagaagtcagacatcaagtggtacggcaagtacctcaacaaccatttgggacgcaccgtgatgttaacggttcagttcactctcggctggcctttgtacttag

SEQ ID NO: 21015 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccatcgacgccaccattccaacaccggatccctcgagagggatgaagtgttcgtccccaagaagaagtcagacatcaagtggtacggcaagtacctcaacaaccctttgggacgcaccgtgatgctaacggttcagttcactctcggctggcctttgtacgtag

SEQ ID NO: 21016 - DNA, 403 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagcaagatcgctttccctcgcgcgcagatcagttggaagaatttgtccgtcatcgacgccaccattccaacactggctccctcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 21017 - DNA, 445 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagttgcgcgttcaaaagtcgcctaaggtcactatcagctagcaaatatttcttgtcaaaaatgctccactgacgtggtccagcggctgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21018 - DNA, 455 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctgacggtccagcgcctgcttgccggtgctgtgcccggcccacggctagaccccccagcaggtgggggccgtggccagcagtggcgggggcgagcaggcgctggagtcatcgacgccaccatgccaacactggctccctcgagagagacgaagtgttggtccccaagaagaagtcagacatcaagtggtgcggcaaggacctcagcatccgtgggggacggggggtggggttagcggttcagttggctctcggctggcctgagtaattag

SEQ ID NO: 21019 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcagtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21020 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggtctcatcttccactcctgcctcctcgtcccttacttctccacgacgccaccattccaacactggctccctcgagagagacgaagtgtttgtccccaagaagaagtcagacatcaagtggtacggaaaggacctcaacaacccgctaggacgcacggtgatgctaaccggccagttcacgctcggctggcctttgtacttag

SEQ ID NO: 21021 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttttgtacttag

SEQ ID NO: 21022 - DNA, 351 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21023 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacaccggatccctcgagagggatgaagtgttcgtccccaagaagaaatccgacatcaagtggtacggaaagtacctcaacaacccgctaggacgcacggtgatgctaacggttcagttcactctcggctggcctttgtacttag

SEQ ID NO: 21024 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21025 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgctaggacgcgcggtgaggctaaccgtccagttcacgctcggctggcctttgtacttag

SEQ ID NO: 21026 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccagcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21027 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaaccagtcagacatcgagtggtacggcaactacctcagcaaccctctgggccgcaccgtgaggttaacgcttcagttcactctcggctggcttttgtacttag

SEQ ID NO: 21028 - DNA, 354 bp, Artificial
  Mutation in BnaC.FAD2.a introduced by TALE nuclease pair BnFAD2_T02
cctctcctccctcaccctctctcctacttcgcctggcctcactactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacagccctgtgggacgcgccgtgaggttaacggttcagttcactctcggctggcctttgtacttag

SEQ ID NO: 21029 - DNA, 357 bp, Artificial
  Mutation in BnaC.FAD2.a introduced by TALE nuclease pair BnFAD2_T02
gctctcctccctcaccctctctcctacttcgcctggcctctctactgggcctgccaagggtgcgtcctaaccggcgtctgggtcatagcccacgagtgcggccaccacgccttcagcgaccaccagtggcttgacgacaccgtcggtctcatcttccactccttcctcctcgtcccttacttctcctggaagtacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21030 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 21031 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21032 - DNA, 353 bp, Artificial
  Mutation in BnaC.FAD2.a introduced by TALE nuclease pair BnFAD2_T02
cctctcctccctcaccctctctcctagttcttgtggccactcgactcttcctcccaaggccgcgccctaaccggcgtctgggtcatagcccacgagtgcggccaccacgccttcagcgactaccagtggcttgacgacaccgtcggtctcatcttccactccttcctcctcgtcccttacttctcctgaaaatcgacgccaccattccaacactggctccctcgagagagacgaagtgtttgtccccaagaagaagtcagacatcaagtggtacggcaagtcctcgaccgccccagttggacgcaacgggatgctacccgttccgctccctctcggctggcctttgtacttag

SEQ ID NO: 21033 - DNA, 399 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagccgaagtttccaaaaggtcgttgatcaaagctcgccgcgttcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggcctttgtacttag

SEQ ID NO: 21034 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggcttgacgacaccgtcggtctcatcttccactccttcctcctcgtcagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21035 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcctctgggtcatcgcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21036 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtgggacggcgagtacctaaacaaccaggtgggacgcaccgtgatgttaacggttcagttctctctcggctggccttagtacttag

SEQ ID NO: 21037 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtcaccaagaagaagtcagacatcaagtggtacggcaagtacctcaacaacccgctaggacgcacggtgatgctaaccgtccagttcacgctcggctggcctttgtacttag

SEQ ID NO: 21038 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21039 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaaatccgacatcaagtggtacggaaagtacctcaacaacccgctagaacgcgcggtgatgctaaccgtccagtgcacgctcggctggccttggtacttag

SEQ ID NO: 21040 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaatcatcgacgccaccattccaacactggctcccccgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21041 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 21042 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaatactggctccctcgacagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 21043 - DNA, 355 bp, Artificial
  Mutation in BnaC.FAD2.a introduced by TALE nuclease pair BnFAD2_T02
cctctcctccctcaccctctctcctacttcgcctgccctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgaagttaacggttcagttcactctcggctggcctttgtacttag

SEQ ID NO: 21044 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggcaccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21045 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactacttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21046 - DNA, 431 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacattgctggcgatggccaccacctgctggggggtcaagccgtgggcctggcacagcaccggcaacagccgctggagccatcgacgccaccattccaacaccggatcactcgagagggatgaagtgttcgtccccaagaagaagtcagacatcaagtggtacggcaagtacctcaacaaccctttgggacgcaccgtgatgttaacggttcagttcactctcggctggcctgtgtacttag

SEQ ID NO: 21047 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21048 - DNA, 343 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21049 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagtgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21050 - DNA, 294 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21051 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctttgggacgcaccgtgatgttagcggttcagttcactctcggctggcctttgtacttag

SEQ ID NO: 21052 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 21053 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 21054 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21055 - DNA, 357 bp, Artificial
  Mutation in BnaC.FAD2.a introduced by TALE nuclease pair BnFAD2_T02
cctctcctccctcacactctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 21056 - DNA, 403 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcaagatcgcttggcctcgcgcgcagatcagttggaagaatttgtccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 21057 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21058 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21059 - DNA, 291 bp, Artificial
  Mutation in BnaC.FAD2.a introduced by TALE nuclease pair BnFAD2_T02
cctcccctccctccccctctctcctacttcgcctggcctctctactgggcctgccacgggtgcgtcctaaccggcgtctgggtcatagcccacgagctcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21060 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcct

SEQ ID NO: 21061 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgcctcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21062 - DNA, 344 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21063 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 21064 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21065 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaattacctcaacaacccgctaggacgcacggtgatgctaaccgtccagttcacgctcggctggccttagtacttag

SEQ ID NO: 21066 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccgccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 21067 - DNA, 421 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccaggggcttgacgacaccgtcggtctcatcttccactccttcctcctcgtcccttacttctcctggaagtaaggtttcatttagcgcctcaaatagatcctgttcaggaaccggatcaaagagttcccccgcagtcatcgacgccaccactccaacactggctacctcgagagagacgaagtgtttgcccccaagaagaagtcagacatcaagtggtacggcaagtacctcaacaaccttttgggacgcaccgtgatgttaccggttcagttcacgttcggctggcctgtgtacttag

SEQ ID NO: 21068 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtactta

SEQ ID NO: 21069 - DNA, 400 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaaccgcctctccccgcgcgttggcacgacaggtttcccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21070 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21071 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21072 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21073 - DNA, 336 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21074 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggatgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21075 - DNA, 354 bp, Artificial
  Mutation in BnaC.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21076 - DNA, 420 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccgctgccaagttcgagagacagcacatggacagcatcgatgcctcgggcatccaagcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21077 - DNA, 346 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21078 - DNA, 449 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaatcacggcctggcacagcaccggcaccagccgctggaccgtctccagcgcctgcttgccaccgccattgctggcgatggccaccacctgctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21079 - DNA, 435 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaacgaacaggtcactatcagtcaaaataaaatcattatttgccatgtcggttcgagatggcgctcgaggacgccagtcatcgacgcctccattccatcactggctccctcgagagagacgaagtgttcgtccccaagaagaagtcagacatcaagtggtacggcaagtacctcaacaaccctttgggccgcaccgtgatgttaacggttcagttcacgctcggctggcctttgtacttag

SEQ ID NO: 21080 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21081 - DNA, 358 bp, Artificial
  Mutation in BnaC.FAD2.a introduced by TALE nuclease pair BnFAD2_T02
cctctcctccctcaccctctctcctacttcgccttgcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21082 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtaggtctcatcttccactccttcctcctcgtcccttactaacagtcatcgacgccaccattccaacactggctccctcgagagagacgaagtgtttgaccccaagaagaagtcagacatcaagtggtacggcaagtacctcaacaaccctttgggacgcaccgtgatgttaacggttcagttcacgctcggctggcctttgtacttag

SEQ ID NO: 21083 - DNA, 345 bp, Artificial
  Mutation in BnaC.FAD2.a introduced by TALE nuclease pair BnFAD2_T02
cctctcctccctcaccctctctcctacttcgcctggcctctctactgtgcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21084 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgggcgctcggtcgttcggctgcggcgagcggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21085 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcacagcccacgagtgcggccaccacgccttcagcgactaccagtggcttgacgaagccgtcggtcacatgttccactccttcctccacatcccttacttctcctggaagtatcatcgacgccaccataccaacactggctcccacgagagagacgaagtgtttgtccccaagaagaaaacaaacatcaagtggtacggcaagtacctcaacaaccgtttgagacggagcgtgatgttaacggttcagttcactctcggctggccttagtacttag

SEQ ID NO: 21086 - DNA, 439 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccggtgctgtgccaggcccacggcttgaccccggagcaggtggtggccatcgccagccacgatggcggcaagcaggcgcagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21087 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaacccgttgggacgcaccgtgatgttaacggttcagtgcactcgcggctggcctgtgtacttag

SEQ ID NO: 21088 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgatcgacgccaccattccaacaccggatccctcgagagggatgaagtgttcgtccccaagaagaaatccgacatcaagttgtacggaaagtacctcaacaacccgctaggacgcaccgttatgttaacggttcagttcactctcggctggcctttgtacttag

SEQ ID NO: 21089 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgtgtcctaacgggcctctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21090 - DNA, 355 bp, Artificial
  Mutation in BnaC.FAD2.a introduced by TALE nuclease pair BnFAD2_T02
cctctcctccctcaccctctctcctacttcgcctggccactctactgggcctgacaagggcgagtccaaaccgccggctgggtcatagcacacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggcgcggcagttcgccgaccacgcctgttgggtacacgggacagccaaccgtcccgttccctctcggctggcctttgtacttag

SEQ ID NO: 21091 - DNA, 356 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaagggttcagttcactctcggctggcctttgtacttag

SEQ ID NO: 21092 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccattacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21093 - DNA, 454 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctgacggtccagcggctgttgccggccctgtgccaggcccacggcttgaccccccagcaggcggtggccatcgccagcaatggcggtggcaagcaggcgctggagtcagcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21094 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtccgtcctaaccggcgtctgggtcatagcccacgagtgcggccaccacgccttcagcgactaccagtggcttaacgacaccgtcggtctcatcgactccaccattccatcactggctccctcgagagagacgaagtgtttgtccccaagaagaagtcagacatcgagtggtacggcaggtacctcaacgacccttttggacgcagcgtggtgttaacggttcagttcccgctcggctggcctttgtacttag

SEQ ID NO: 21095 - DNA, 312 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21096 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 21097 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 21098 - DNA, 422 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21099 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 21100 - DNA, 402 bp, Artificial
  Mutation in BnaC.FAD2.a introduced by TALE nuclease pair BnFAD2_T02
cctctcctccctcaccctctctcctacttcgcctggcctctctaatgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggactgccgctgccaagttctagagacagcacatggacagcatcgatacagtcatagacgccaccattccaacaccggatccctcgagagggatgaattgttcgtccccaacaagaaatccgacatcaagtggtacggaaagtacctcaacaacccgcgagggcgcacggttatgctaaccgtccagttcacgctcggctggcctttgtacttag

SEQ ID NO: 21101 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 21102 - DNA, 395 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccgccggagtaggccttggtgtccacgatcacgccgtagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21103 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21104 - DNA, 361 bp, Artificial
  Mutation in BnaC.FAD2.a introduced by TALE nuclease pair BnFAD2_T02
ctctcctccctcaccctctctcctacttcgcctggcctctctactgggcctgccaagggtgcatcctaaccggcgtctgggtcatagcccacgagtgcggccaccacgccttcagcgactaccagtggcttgacgacaccgtcggcctcatcttccacaccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21105 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21106 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtgtcatcgacgcctccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21107 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggccttttacttag

SEQ ID NO: 21108 - DNA, 347 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaaatccgacatcaagtggtacggaaagtacctcaacaacccgctaggacgcacggtgaggctaaccgtccagttcacgctcggctggcctttgtacttag

SEQ ID NO: 21109 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctctgggacgcaccgtgatgctaacggttcagttcactctcggctggcctttgtacttag

SEQ ID NO: 21110 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 21111 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggccgcacggtgatgctaaccgtccagttcacgctcggctggcctttgtacttag

SEQ ID NO: 21112 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 21113 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21114 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21115 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 21116 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaggaagaagtcagacatcaagtggtacggcaagtacctcaacaaccctttgggacgccccgtgatgttaacggttcagttcactcgcggctggcctttgtacttag

SEQ ID NO: 21117 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccactccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21118 - DNA, 358 bp, Artificial
  Mutation in BnaC.FAD2.a introduced by TALE nuclease pair BnFAD2_T02
cctctcctccctcaccctctctcctacttcgcctggcctctctcctgggcctgccagggatgcgtcctaaccggcgtctgggtcatagcccacgagtgcggccaccacgccttcagcgactaccagtggcttgacgacaccgtcggtctcatcttccactccttcctcctcgtcccttacttctcctggcacagtcatcgacgccaccattccaacactggctccctcgagagagacgaagtgtttgtccccaagaagaagccagacatcaagtggtacggcaactactccaccgacccttcgggacggtctatgaggtaaacgctccgcttcactctcggctggcctttgtacttag

SEQ ID NO: 21119 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21120 - DNA, 319 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21121 - DNA, 293 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccctttgtacttag

SEQ ID NO: 21122 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaaatccgacatcaagtggtacggaaagtacctcaacaacccgctaggacgcacggtgaggctaaccgtccagttcacgctcggctggcctttgtacttag

SEQ ID NO: 21123 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21124 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21125 - DNA, 445 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagttgcgcgttcaaaagtcgcctaagggcactatcagctagcaaatatttcttgtcaaaaatgctccactgacgtggtccagcggctgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21126 - DNA, 312 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttaacgacaccgtcggtctcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21127 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21128 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagtcatcaagtggtacggcaagtacctcaacaaccctttgggacgcaccgtgatgttaacggttcagttcactctcggctggcctttgtacttag

SEQ ID NO: 21129 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcatcgtcccttacttctcctggatgtcatcgacgccaccattccaacactggctccctcgagagagacgaagtgtttgtccccaagaagaagtcagacatcaagtggtacggcaagtacctcaacaaccctttgggacgcactgtgatgttaacggttcagttcactctcggctggcctttgtacttag

SEQ ID NO: 21130 - DNA, 357 bp, Artificial
  Mutation in BnaC.FAD2.a introduced by TALE nuclease pair BnFAD2_T02
cctctcctccctcaccctctaccttacctcgcctggcccctctactgggcctgccaaggctgcgtcctatcgggcctctgggtcatcgcccacgaatgcggccaccacgccttcagcgaccaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21131 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 21132 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcggcgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 21133 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagccatcgacgccaccattccaacaccggatccctcgagagggatgaagtgttcgtccccaagaagaaatccgacaccaagtggtacggaaagtacctcaacaaccctttgggacgcaccgtgatgttaacggtgcagttcactctcggctggcctttgtacttag

SEQ ID NO: 21134 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 21135 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagtagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21136 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21137 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctttacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 21138 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21139 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgttagtccccaagaagaagtcagacatcaagtggtacggcaagtacctcaacaaccctttgggacgcaccgtgatgttaaccgttcagttcactctcggctggcctttgtacttag

SEQ ID NO: 21140 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21141 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggccatcgacgccaccattccaacaccggatccctcgagagggatgaagtgttcgtccccaagaagaaatccgacatcaagtggtacggaaagtacctcaacaccccgctaggacgcaccgtgatgttaacggttcagttcactctcggctggcctttgtacttag

SEQ ID NO: 21142 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggacatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttcg

SEQ ID NO: 21143 - DNA, 350 bp, Artificial
  Mutation in BnaC.FAD2.a introduced by TALE nuclease pair BnFAD2_T02
ccctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21144 - DNA, 356 bp, Artificial
  Mutation in BnaC.FAD2.a introduced by TALE nuclease pair BnFAD2_T02
cctctcctccctcaccctctctcctacttctcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggttcgccaattccctcaacacccctgttggacgcaccgtgatgccaacggttcagttccctctcggctggcctttgtacttag

SEQ ID NO: 21145 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtatgtccccaagaagaagtcagacatcaagtggtacggcaagtacctcaacaaccctttgggacgcaccgtgatgttaacggttcagttcactctcggctggcctttgtacttag

SEQ ID NO: 21146 - DNA, 357 bp, Artificial
  Mutation in BnaC.FAD2.a introduced by TALE nuclease pair BnFAD2_T02
cctctcctccctcaccctctctcctacttcgtctggcctctctactggtcctgccaagggcgcgtcctaaccggcgtctgggacatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagcagaagccagacatcaagtggcccctcaagtcctccaccacgcctgttgtacgcacggtgctgccaccccttccgttccctctcggctggcctttgtacttag

SEQ ID NO: 21147 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21148 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccattacttctccatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 21149 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagtgactaccagtggcttgacgacaccgtcggtctcatcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21150 - DNA, 356 bp, Artificial
  Mutation in BnaC.FAD2.a introduced by TALE nuclease pair BnFAD2_T02
cctctcctccctcaccctctctcctacttcgcctggcctctctcctgggcctgccaaggatgcgtcccaaccggcgtctgggtcacagcccacgagtgcggccaccacgccttcagcgactaccagtggcttgacgacaccgtcggcctcatcttccactccttcctccccgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaagggttcaggtcactctcggctggcctaagtacttag

SEQ ID NO: 21151 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21152 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 21153 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtaagtcatcgacgccaccattccaacaccggatccctcgagagggatgaagtgttcgtccccaagaagaaatccgacatcaagtggtacgacaagtacctcaacaaccctttgggacgcaccgtgatgttaacggttcagttcactctcggctggcctttgtacttag

SEQ ID NO: 21154 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtcttggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 21155 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 21156 - DNA, 393 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagactgagcctttcgttttatctgttgtttgtcggtgaacgctcgccagcaaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 21157 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 21158 - DNA, 441 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtgccaggcccacggcttgaccccccagcaggtggtggccatcgccggccagcaacgtcggttcgagatggcgctcgatgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21159 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 21160 - DNA, 356 bp, Artificial
  Mutation in BnaC.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21161 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccagtccaacactggctccctcgagagagacgaagtgtttgtccccaagaagaagtcagacatcaagtggtacggcaagtacctcaacatgccttttggacgcaccgtggtgtaaacggttcggttcagtctcggctggcctttgcaactag

SEQ ID NO: 21162 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacataaagtggtacggcaagtacctcaacaaccctttgggacgcaccgtgatgttaacggttcagttcactctcggctggcctttgtacttag

SEQ ID NO: 21163 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21164 - DNA, 357 bp, Artificial
  Mutation in BnaC.FAD2.a introduced by TALE nuclease pair BnFAD2_T02
cctctcctccctcaccctctcccctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21165 - DNA, 358 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttatcgacaccgtcggtctcatcttccactccttcctcctcgtcccttacttctcctggaagtatcatcgacgccaccattccaacactggctccctcgagagagacgaagtgtttgtccccaagaagaagtcagacatcgagtggtacggcaagtacctcaacaaccctttggaacgccccgtgatgttaacggttcagttcactctcggctggccttagtacttag

SEQ ID NO: 21166 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21167 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21168 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacaaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 21169 - DNA, 322 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactatcggctggcctttgtacttag

SEQ ID NO: 21170 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 21171 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggtgcagttcactctcggctggcctttgtacttag

SEQ ID NO: 21172 - DNA, 343 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggactttgtcttag

SEQ ID NO: 21173 - DNA, 356 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 21174 - DNA, 357 bp, Artificial
  Mutation in BnaC.FAD2.a introduced by TALE nuclease pair BnFAD2_T02
catctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21175 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagccatcgacgccaccattccaacaccggatccctcgagagggatgaagtgttcgtccccaataagaaatccgacatcaagtggtacggaaagtacctcaacaacccgctaggacgcacggtgatgctaaccgtccagttcacgctcggctggcctttgtacttag

SEQ ID NO: 21176 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggcctttgtacttag

SEQ ID NO: 21177 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttaagagactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21178 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccctcctcctcgtcccttacttctcctggaagttgtcatcgacgccaccattccaacactggctccctcgagagggatgaagcgttcgtccccaagaacaaatccgacctcacgtggtacgtaaactacctcaacaaccctctagtacgcagggtgatgctaaccccccggttcccgctcggctggcctttgtacttag

SEQ ID NO: 21179 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtcgcttgacgacatcgtcggtctcatcttccactccttccccctcgtcccttccttctcctgtacactcatcgacgccaccattccaacactggctccctcgagagagacgaagtgtttgtccccaagaagaagtcagacatcaagtggtacggcaagtacctcaacaagcctttgggacgcaccgtgatggtaacggcacagttctctcgcggctggccttggtacttag

SEQ ID NO: 21180 - DNA, 330 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 21181 - DNA, 420 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtactggaccgtctccagcgcctgcttgaaagataccaggcgtttccccctggaagctccctcagtcatcgacgccaccagtccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 21182 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacctag

SEQ ID NO: 21183 - DNA, 359 bp, Artificial
  Mutation in BnaC.FAD2.a introduced by TALE nuclease pair BnFAD2_T02
cctctcctccatcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtaccttaacaaccctttgggacgcaccgtgatgttaacggttcagttcactctcggctggcctttgtacttag

SEQ ID NO: 21184 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 21185 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcccatcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21186 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatatcgacgccaccattccaacactggctccctcgagagagacgaagtgtttgtccccaagaagaagtcagacatcaagtggcacggcaagtaccccaacgaccctttggtacgcaccgtgatgttaacccttcagttccctctcggctggcctttgtacttag

SEQ ID NO: 21187 - DNA, 355 bp, Artificial
  Mutation in BnaC.FAD2.a introduced by TALE nuclease pair BnFAD2_T02
cctctcctcctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgttcccaagaagaagtcagacatcaagtggtacggcgagtacctcaacaaccctttgggacgcagcgtgaggttaacggttcagttctctctcggctggcctttgtacttag

SEQ ID NO: 21188 - DNA, 343 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctacttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21189 - DNA, 350 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctcatcgacgccaccattccaacaccggatccctcgagagggatgaagtgttcgtccccaagaagaagtcagacatcaagtggtacggcaagtacctcagcaaccctttgggacgcgccgtgatcttaacggttcagttcactctcggctggcctttgcacttag

SEQ ID NO: 21190 - DNA, 395 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagttgaccccccagcaggtggtggccatcgccagccaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21191 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtatgtccccaagaagaagtcagacatcaagtggtacggcaagtacctcaacaaccctttgggacgcaccgtgatgttaacggttcagttcactctcggctggcctttgtacttag

SEQ ID NO: 21192 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcttgcctttgtacttag

SEQ ID NO: 21193 - DNA, 344 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21194 - DNA, 356 bp, Artificial
  Mutation in BnaC.FAD2.a introduced by TALE nuclease pair BnFAD2_T02
cctctcctccctcaccctctctcctacttcgcctggcctctctactggtcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaacccgctaggacgcccggtgatgctaaccgtccagttcacgctcggctggcctttgtacttag

SEQ ID NO: 21195 - DNA, 420 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtactggaccgtctccagcgcctgcttgaaagataccaggcgtttccccctggaagctccctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21196 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctctgtacttag

SEQ ID NO: 21197 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21198 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgatcggctggcctttgtacttag

SEQ ID NO: 21199 - DNA, 357 bp, Artificial
  Mutation in BnaC.FAD2.a introduced by TALE nuclease pair BnFAD2_T02
cctctcctctctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgccccttacttctcctggaaagtcatcgacgcctccattccaacactggctccctcgagagagacgaagtgtttgtccccaagaagaagtcagacatcaagtggtacggaaagtacctcaacgaccctttgggacgcacgaggatgttaacggttcagttcactctcggctggcctttgtccttag

SEQ ID NO: 21200 - DNA, 448 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatccaagataagcctgtctagcttcaagtatgacgggctgacttggacaagaagaagatcgcttggcctcgcgcgcagatcagttggatacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21201 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccggtaggacgcacggtgatgctaaccgtccagttcacgctcggctggcctttgtacttag

SEQ ID NO: 21202 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacaccggatccctcgagagggatgaagtgttcgtccccaagaagaaatccgacatcgagtggtacggaaagtacctcaacaacccgctaggacgcacggtgatgctaaccgtccagttcacgctcggctggcctttgtacttag

SEQ ID NO: 21203 - DNA, 319 bp, Artificial
  Mutation in BnaC.FAD2.a introduced by TALE nuclease pair BnFAD2_T02
cctctcctccctcaccctctcccttacctctcctggcccctctactgggcctgccaaggctgcgtcctaacgggcctctgggtcatcgcccacgaatgcggccaccacgccttcagcgaccaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21204 - DNA, 405 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacagcgcctgcttgccaccgccattgctggcgatggccaccacctgtggcggcgacgccaccattccaacactggctccctcgtgagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21205 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccagtccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21206 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21207 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgcctccattccaacactggctccctcgagagagccgaagtgtttgtccccaagaagaagtcagacatcgagtggtacggcaagtacctcaacacccctttgggacgcaccgtgatgttaacggtgcaggtcactctcggctggccttagtacttag

SEQ ID NO: 21208 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 21209 - DNA, 344 bp, Artificial
  Mutation in BnaC.FAD2.a introduced by TALE nuclease pair BnFAD2_T02
cctctcctccctcaccctctcccttacctcgcctggcccccctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcgagtggtacagcaagtacctcaacaaccctttgggacgcaccttgatgttagcggttcagggcactctgggcgtgccgtggtacgtag

SEQ ID NO: 21210 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccacgatggcggcaagcaggcgctggagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21211 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcataaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21212 - DNA, 443 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcttcgagccagccacgatcgacattgatctggctatcttgctgacaaaggcgctggagacggtccagcggctgttgccggtgctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 21213 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcgcagtgatgttaacggttcagttcactctcggctggccttggtacttag

SEQ ID NO: 21214 - DNA, 462 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtaccgtctccagcgcctgcttgccgccatcgtggctggcgatggccaccacctgctccggggtcaagccgtgggcctggcacagccccggcaacagccgctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21215 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctactggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21216 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggtcaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21217 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21218 - DNA, 292 bp, Artificial
  Mutation in BnaC.FAD2.a introduced by TALE nuclease pair BnFAD2_T02
cctctcctccctcaccctctctcctacttcgcctggcctctctacttggcctgccaagggtgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaacccgctaggacgcacggtgatgctaaccgtccagttcacgctcggctggccctttgtacttag

SEQ ID NO: 21219 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcatcgacgccaccattccaacaccggatccctcgagagagatgaagtgctcgtccccaagaagaagtcagacatcaagtggtacggcaagtgccacaacaaccctctggagcgcaccgtgatgttaacggttcaattcactctcggctggcatttgtgcttag

SEQ ID NO: 21220 - DNA, 294 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21221 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctggatcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21222 - DNA, 387 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggcgatggccaccacctgctccggggtcacagtcatcgacgccaccattccaacactggctccctcgagagagacgaagtgtttgtccccaagaagaagtcagacatcaagtggtacggcaagtacctcaacaaccctttgggacgcgccgtgaggttaacagttcagttcactctcggctggcctttgtacttag

SEQ ID NO: 21223 - DNA, 332 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaactggctccctcgagagagacgaagtgtttgtccccaagaagaagtcagacatgaagtggtacggcaagtacctcaacaaccctttgggacgcaccgtgatgttaaccgttcagttcactctcggctggcctttgtacttag

SEQ ID NO: 21224 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21225 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacacggcctccctcgcgagagacgaagtgtttgcccccaagaagacgtcagacatcaactggtccggcaagtccctcaacaaccctttgggtcgcaccgtgatgttaacggttcagttcactctcggctggcctttgtacttag

SEQ ID NO: 21226 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgcctcagcgactaccagtggcttgacgacaccgtcggtctcatcttccactccttcctcctcgtcccttacttctcctggaagttgccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21227 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttgtcatcgacgccaccattccaacactggctccctcgagagggatgaagtgttcgtccccaagaagaaatccgacatcaagtggtacggaaagtacctcaacaacccgctagggcgcacggtgatgctaaccggccatttcacgctcggctggcctttgtacttag

SEQ ID NO: 21228 - DNA, 321 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 21229 - DNA, 397 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccagcagtggtttgtttgccggaaaaagagttggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21230 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaagtcatcgacgccaccattccaacactggctccctcgagagagacgaagtgtttgtccccaagaagaagtcagacatcaactggtacggcaggttccgaaacatccctctgggccgcaccgtgatgttaaccgctcagttcactctcggccggcctcagcacctag

SEQ ID NO: 21231 - DNA, 356 bp, Artificial
  Mutation in BnaC.FAD2.a introduced by TALE nuclease pair BnFAD2_T02
cctctcctccctcaccctctctcctacttcgcctggcatctctactgggcctgccaagggggcgtcctaaccggcgtctaggtcatagaccacgagtgcggccaccacgccttcagcgacgaccagtggcttgacgacaccgtcggtctcctctgccactccttcctcctcgtcccttacttctcctggaagtcagcgacgccaccattccaaccctggctccctcgagagagacgaagtgtttgtccccaagaagaagtccgacatcaactggtccggcaagttcctcaacaaccttttgggacgaccagtgacagtatcggtgcagttcactctccgccggcctttgtacttag

SEQ ID NO: 21232 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21233 - DNA, 358 bp, Artificial
  Mutation in BnaC.FAD2.a introduced by TALE nuclease pair BnFAD2_T02
cctctcctccctcaccctctcccttacctcgcatggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttggtacgccccgtgatgttaacggttcagttccctctcggcttgcctttgtacttag

SEQ ID NO: 21234 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctatcgacgccaccattccaacactggctccctcgagagggatgaagtgttcgtccccaagaagaaatccgacatcaagtggtacggaaagtacctcaacaacccgctaggacgcacggtgatgctaaccggccagttctcgctcggctggcctttgtacttag

SEQ ID NO: 21235 - DNA, 357 bp, Artificial
  Mutation in BnaC.FAD2.a introduced by TALE nuclease pair BnFAD2_T02
cctctcctccctaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21236 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcttcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21237 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaactgttcagttcactctcggctggcctttgtacttag

SEQ ID NO: 21238 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 21239 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacaccggatccatcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21240 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21241 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 21242 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttatcagatcagttcactctcggctggcctttgtacttag

SEQ ID NO: 21243 - DNA, 358 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 21244 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21245 - DNA, 357 bp, Artificial
  Mutation in BnaC.FAD2.a introduced by TALE nuclease pair BnFAD2_T02
cctctcctgcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21246 - DNA, 399 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagccgaagtttccaaaaggtcgttgatcaaagctcgccgcgttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21247 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21248 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgactccaccattccaacactggctccctcgagagagacgaagtgttcgtccccaagaagaaatccgacatcaagtggtacggaaagtacctcaacaacccgctatgacgcacggtgatgctaaccgaccagttcactctcggctggcctttgtacttag

SEQ ID NO: 21249 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 21250 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 21251 - DNA, 349 bp, Artificial
  Mutation in BnaC.FAD2.a introduced by TALE nuclease pair BnFAD2_T02
cctctcctccctcaccctctctcctacttcgcctggcctctctactgtgcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcccatcgacgccaccattccaacactggctccctcgagagagacgaagtgtttgtccccaagaagaagtcagacatcaagtggtacggcaagtacctcaacaacccttggggacgcgccgtgatgttaacggtgcagttcactctcggctggccttagtacttag

SEQ ID NO: 21252 - DNA, 321 bp, Artificial
  Mutation in BnaC.FAD2.a introduced by TALE nuclease pair BnFAD2_T02
cctctcctccctcaccatctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21253 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacagcaagtacctcaacaaccctttgggacgcaccgtgatgttaaccgttcagttcactctcggctggcctttgtacttag

SEQ ID NO: 21254 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21255 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctcacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 21256 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaaggatgcgtcctaaccggcgtctgggtcatagcccacgagtgcggccaccacgccttcagcgactaccagtggcttgacgacaccgtcggtctcatcttccactccttcctcctcgtcccgtacagtcatcgacgccaccattccaccactggctccctcgagagagacgaagtgtttgtccccacgaagaagtcagacaccaagtggtacgccaagtccctcaacaccccttcgggacgcaccgtgatgttaaccgttcagttcgctctcggcttgccgttgtacttag

SEQ ID NO: 21257 - DNA, 306 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgggacgcgccgtgatgttaacggttcagttctctctcggctggcctttgtacttag

SEQ ID NO: 21258 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 21259 - DNA, 356 bp, Artificial
  Mutation in BnaC.FAD2.a introduced by TALE nuclease pair BnFAD2_T02
cctctcctcctcaccctctctcctacttcgcctggcctctctactgggcctgccaatggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21260 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcaactaccagtggcttgacgacaccgtcggtctcctcttccactccttcctcctcgtcccttacttctcctggaagttacagtcatcgacgccaccattccaacaccggatccctcgagagggatgaagtgttcgtccccaagaagaaatccgacatcaagtggtacggcaagtacctcaacaaccctttggggcgcaccttgatgttaacgggtcagttctctctcggctggcctttgtacctag

SEQ ID NO: 21261 - DNA, 392 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtacagcaccggcaacagccgctggaccgtctccagcgcctgcttgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21262 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21263 - DNA, 467 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcctcttccactccttcctcctcgtcccttacttctcctggaagtggaaagcgggcagtgagcgcaacgcaattaagctcgccgcgttgtttcatcaagccttacggtcaccgtacccagcaaatcaatatccctgtgtggccccaggccgccagtcatcgccgccaccattccaaccctggctccctcgagagagacgaagtgtttgtccccaagaagaagtcagacatcaagtggtacggcaagtacctcaacacccctttgggacgcaccgtgatgttaacggttcagttcacgctcggctggcctttgtacttag

SEQ ID NO: 21264 - DNA, 356 bp, Artificial
  Mutation in BnaC.FAD2.a introduced by TALE nuclease pair BnFAD2_T02
cctctcctccctcaccctctcccttacctcgcctggcctatctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21265 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 21266 - DNA, 356 bp, Artificial
  Mutation in BnaC.FAD2.a introduced by TALE nuclease pair BnFAD2_T02
cctctcctccctcaccctctctcctacttcgcctggcccctctattggccctgccaagggcgcgccctaaccggcgtctgggcaatagcccacgagtgcggccaccacgccttcagcgactaccagtgccttgaccacaccgtcggtctcatcttccactccttcctcctcgtcccttacttctcctggacgtcaccgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 21267 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 21268 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggtctttgtacttag

SEQ ID NO: 21269 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcctcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21270 - DNA, 379 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcgttcggctgcggctagcggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21271 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 21272 - DNA, 370 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21273 - DNA, 359 bp, Artificial
  Mutation in BnaC.FAD2.a introduced by TALE nuclease pair BnFAD2_T02
cctctcctccctcaccctatctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 21274 - DNA, 358 bp, Artificial
  Mutation in BnaC.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21275 - DNA, 435 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaacgaacaggtcactatcagtcaaaataaaatcattatttgccatgtcggttcgagatggcgctcgatgacgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21276 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatatcccacgagtgcggccaccacgccttcagcgactaccagtggcttgacgacaccgtcggtctcatcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21277 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21278 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccatgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21279 - DNA, 349 bp, Artificial
  Mutation in BnaC.FAD2.a introduced by TALE nuclease pair BnFAD2_T02
cctctcctacctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctgtgggacgcacggtgatgttaacggttcagttcactctcggctggcctttgtacttag

SEQ ID NO: 21280 - DNA, 356 bp, Artificial
  Mutation in BnaC.FAD2.a introduced by TALE nuclease pair BnFAD2_T02
cctctcctccctcaccctctcccttacctcggctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcgccgtgatgttaacggtgcagttcactctcggctggcctttgtacttat

SEQ ID NO: 21281 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggatttgtcctactcaggagagcgttcaccgacaaacaacagataaaacgaaaggccgtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21282 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 21283 - DNA, 291 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21284 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21285 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 21286 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagtcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 21287 - DNA, 331 bp, Artificial
  Mutation in BnaC.FAD2.a introduced by TALE nuclease pair BnFAD2_T02
cctctcctccctcaccctctcccttacctcgcctggcccctctactgggccttccaaggctgcgtcctaacgggcctctgggtcatcgcccacgaatgcggccaccacgccttcagcgactaccagtggcttgacgacactgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21288 - DNA, 357 bp, Artificial
  Mutation in BnaC.FAD2.a introduced by TALE nuclease pair BnFAD2_T02
cctctccctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 21289 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21290 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgttcgtccccaagaagaaatccgacatcaagtggtacggaaagtacctcaacaacccgctaggacgcaccttgatgttaacggttcagttcactctcggctggcctttgtacttag

SEQ ID NO: 21291 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctctagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21292 - DNA, 412 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21293 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21294 - DNA, 352 bp, Artificial
  Mutation in BnaC.FAD2.a introduced by TALE nuclease pair BnFAD2_T02
cctctcctccctcaccctctctcctacttcgcctggcctctctaccgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttggacttag

SEQ ID NO: 21295 - DNA, 354 bp, Artificial
  Mutation in BnaC.FAD2.a introduced by TALE nuclease pair BnFAD2_T02
cctctcctccctcaccctctctcctacttcgcctggcctctctactgggcctgcaaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21296 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttcccctccttcctcctcgtcccttacttctcctggaaagtcatcgacgccaccattccaacactggctccctcgagagcgacgaagtgtttgtccccaagaagaaggccgccatcaagtggtccgacaagtacctcaccaaaccggtgggacgcaccgtgatgttaacggttaagttcactctcggctggcatttgtacttag

SEQ ID NO: 21297 - DNA, 428 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctccagcgcctgcttgccaccattattgctggcgatggccaccacctgctggggggtcaagccgtgggcctggcacagcacctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21298 - DNA, 352 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcggacatcaagtggtacggcaagtacctcaacaaccctttgggacgcaccgtgatgttaacggttcagttcactctcggctggcctttgtacttag

SEQ ID NO: 21299 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggcctggcacagcaccggcaacagccgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21300 - DNA, 359 bp, Artificial
  Mutation in BnaC.FAD2.a introduced by TALE nuclease pair BnFAD2_T02
cctctcctccctcaccctctcccttacctcgcctgccccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcagcatccctttgggacgcaccgtgaggttaacggcacagttcactctcggctgccctttgtacttag

SEQ ID NO: 21301 - DNA, 357 bp, Artificial
  Mutation in BnaC.FAD2.a introduced by TALE nuclease pair BnFAD2_T02
cctctcctccctcaccctatctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtccgacatcaagtggtacggaaagtacctcaacaacccgctaggacgcacggtgatgctaaccgtccagttcacgctcggctggcctttgtacttag

SEQ ID NO: 21302 - DNA, 356 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 21303 - DNA, 246 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcggcccttacttctcctggaagtacgcaccgtgatgttaacggttcagttcactctcggctggcctttgtacttag

SEQ ID NO: 21304 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcactctcggctggcctttgtacttag

SEQ ID NO: 21305 - DNA, 355 bp, Artificial
  Mutation in BnaC.FAD2.a introduced by TALE nuclease pair BnFAD2_T02
ctctcctccctcaccctctctcctacttcgcctgacctctctactgggcctgccaagggtgcgtcctaaccggcgtctgggtcatagccaacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21306 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtattag

SEQ ID NO: 21307 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacaacaagtggtacggcaagtacctcaacaaccctgtgggacgcaccgtgatgttaacggttcagtgcactctctgctggcctttatacttag

SEQ ID NO: 21308 - DNA, 379 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcgttcggctgcggcgagcggtacagtgatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21309 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21310 - DNA, 273 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21311 - DNA, 311 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgtctttgtccccaagaagaagtcagacatcaagtggtacggcaagtacctcaacaaccctttgggacgcaccgtgatgttaacgtttcagttcactctcggctggcctgtgtacttag

SEQ ID NO: 21312 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagtttactctcggctggcctttgtacttag

SEQ ID NO: 21313 - DNA, 467 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggaaagcgggcagtgagcgcaacgcaattaagctcgccgcgttgtttcatcaagccttacggtcaccgtaaccagcaaatcaatatcactgtgtggcttcaggccgccagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21314 - DNA, 355 bp, Artificial
  Mutation in BnaC.FAD2.a introduced by TALE nuclease pair BnFAD2_T02
cctctcctccctcaccctttcccttacctcgccttgcccctttactgggcctgccaaggctgcgtcctaacgggcctctgggtcatcgcccacgaatgcggccaccatgccttcagcgactaccagtggcttgacgacaccgtcgttctcatcttccactccttcctcctcgtcccttacttctcctggagccatcgacgccaccattccaacactggctccctcgagagagacgaagtgtttgtccccaagaagaagtcagacatcaagtagtacggcaagtacctcaacaacccgttggaacgcaccgtgatgttaacggttcagttcactctcggctggcctgaatacttag

SEQ ID NO: 21315 - DNA, 425 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttccactccatgcatgcactgcctttttgcgtttctacaaactcttcctggctagcggtacgcgtattaattgcgttgcgctcactgcccgctttccagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcacgctcggctggcctttgtacttag

SEQ ID NO: 21316 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagggatgaagtgttcgtccccaagaagaaatccgacatcaagtggtacggaaagtacctcaacaacccgctatgacgcacggtgatgctaaccgtccagttcacgctcggctggcctttgtacttag

SEQ ID NO: 21317 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacagccctttgggacgccccgtgatgttaacggttcagttcactctcggctggcctttgtacttag

SEQ ID NO: 21318 - DNA, 355 bp, Artificial
  Mutation in BnaC.FAD2.a introduced by TALE nuclease pair BnFAD2_T02
cctctcctccctcaccctctctcctacttcgcctggcctctctactgggcctgcccagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacagccctttgtgactcaccgtgatgtcaacggttcagttctctctcggctggcctttgtacttag

SEQ ID NO: 21319 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 21320 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagccatcgacgccaccattccaacaccggatccctcgagagggatgaagtgtttgtccccaagaagaagtcagacatcaagtggttcggcaattacctcaacaacccgttgggacgcaccgtgatgttaacggttcagttcactctcgcctggcctttgtacttag

SEQ ID NO: 21321 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 21322 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggaagactggctccctcgagagagactaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21323 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 21324 - DNA, 389 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggatctcaagaagatcctttgatcttttctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21325 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 21326 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 21327 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtattgagtgagctgataccgctcgccgcagccgaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21328 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 21329 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagatacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21330 - DNA, 330 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 21331 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21332 - DNA, 353 bp, Artificial
  Mutation in BnaC.FAD2.a introduced by TALE nuclease pair BnFAD2_T02
cctctcctccctcaccatctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggacatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctagcctttgtacttag

SEQ ID NO: 21333 - DNA, 467 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacactccttcctcctcgtcccttacttctcttcgtaacgcgcttgctgcttggatgcccgaggcatagactgtaccccaaccagaccaggaacaagcacatcaaccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21334 - DNA, 397 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatgcccgaggcatagactgtaccccaaaaaaacagtcataagtcatcgacgccaccattccaacactggctccctcgagagagacgaagtgtttgtccccaagaagaagtcaaacatcaagtggtacggcaagtacctcaacaaccctgtgggacgcaccgtgatgttaacggttcagttcactctcggctggcctttgtacttag

SEQ ID NO: 21335 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21336 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtgggcctggcacagcaccggcaacagccgctggagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21337 - DNA, 362 bp, Artificial
  Mutation in BnaC.FAD2.a introduced by TALE nuclease pair BnFAD2_T02
cctatcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21338 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21339 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcataacgggcctctgggtcatcgcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21340 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21341 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21342 - DNA, 455 bp, Artificial
  Mutation in BnaC.FAD2.a introduced by TALE nuclease pair BnFAD2_T02
cctctcctccctcaccctctctcctacttcgcctggcctctctactggacctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgacggtccagcgcctgcttgccggtgctgtgccaggcccacggcttgaccccccagcaggtggtggccatcgccagcaatggcggtggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21343 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgagtgcggccaccacgccttcagcgactaccagtggcttgacgacaccgtcggtctcatcttccactccttcctcctcgtcccttacttctcctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21344 - DNA, 358 bp, Artificial
  Mutation in BnaC.FAD2.a introduced by TALE nuclease pair BnFAD2_T02
ccttcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21345 - DNA, 356 bp, Artificial
  Mutation in BnaC.FAD2.a introduced by TALE nuclease pair BnFAD2_T02
cctctcctccctcaccctctctcctacttcgcctgtcctctctactgcgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacactggctccctcgagagagacgaagtgtttgtccccaagaagaagtcagacatcaagtggtccggcaagtaccccaacacccccgtgggccgcgtcgggatgttatcagttccgttctctctcggctggcctttgtacttag

SEQ ID NO: 21346 - DNA, 354 bp, Artificial
  Mutation in BnaC.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21347 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttcaactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21348 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccactccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21349 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctcagtcatcgacgccacctttccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21350 - DNA, 347 bp, Artificial
  Mutation in BnaC.FAD2.a introduced by TALE nuclease pair BnFAD2_T02
cctctcctccctcaccctgtcccttacctcgcctggcccctctactcggcctgccaaggctgcgtcctaacgggcctctgggtcatcgcccacgaatgcggccaccacgccttcagccactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaggtacctcaacatccgtttgggacgcaccgtggggttaaccgttcaggtgactctcggctggcttttgtgcttag

SEQ ID NO: 21351 - DNA, 356 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 21352 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21353 - DNA, 344 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21354 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcttcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21355 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttggacttag

SEQ ID NO: 21356 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaaggatgcgtcctaaccggcgtctgggtcatagcccacgagtgcggccaccacgccttcagcgactaccagtggcttgacgacaccgtcggtctcatcttccactccttcctcctcgtcccgtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 21357 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggactcatcgacgccaccattccaacactggctccctcgagagagacgaagtgtttgtccccaagaagaagtcagacatcaagtggtacggcaagtacctcaacaaccctgtgggacgcaccgggatgttaaccgttccgttccctctcggctggcctttgtacttag

SEQ ID NO: 21358 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttacactccttcctcctcgtcccttacttctcctggaagtagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21359 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaattacctcaacaaccctttgggacgcaccgtgatgttaacggttcagttctctctcggctggcctttgtacttag

SEQ ID NO: 21360 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattacaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21361 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacaacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21362 - DNA, 469 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgcgccgttaccaccgctgcgttcggtcaaggttctggaccagttgcgtgagcgcatacgctacttgcatacttgacagcgacggtccctaacgctgccgggtgttggcttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21363 - DNA, 443 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgcaatgcactgacgggtgccccgctcaacttgacccctctccagcgcctgcttgccgccatcgtggctggcgatggccaccaccagtcaccgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21364 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21365 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggaggcaccgtgatgttaacggttcagttcactctcggctggcctttgtacttag

SEQ ID NO: 21366 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtgcggcaagtacctcaacaaccctttgggacgcaccgtgatgttaacggttcagttcactctcggctggcctttgtacttag

SEQ ID NO: 21367 - DNA, 343 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttactatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21368 - DNA, 353 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaaatcgacgccaccattccaacactggctccctcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 21369 - DNA, 355 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttgaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21370 - DNA, 348 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagggatgaagtgttcgtccccaagaagaagtcaaacatcaagtggtacggcaagtacctcaacaaccctttgggacgcaccgtgatgttaacggttcagttcactctcggctggcctttgtacttag

SEQ ID NO: 21371 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21372 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccacgatggcggcaagcaggcgctggagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21373 - DNA, 412 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctattattattccaccaggtggtggccatcgccagcaataatggtggcaagcaggcgctggagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21374 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21375 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 21376 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgtctccagcgcctgcttgccatcgccagccacgatggcggcttgacccctcagcaggtggtggacgtcaccattccaacactggctccctcgggagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21377 - DNA, 359 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21378 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21379 - DNA, 343 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcatctgggtcatagcccacgagtgcggccaccacgccttcagcgactaccagtggcttgacgacaccgtcggtctcatcttccactccttcctcctcgtccctacttatcgacgccaccatgccaacaccggatccctcgagagggatgaagtgttcgtccccaagaagaaatccgacatcaagtggtacggaaattacctcaacaagccgctagaacggacggtgatgctaaccgtccagttcacgctcggctggcctttgggcttag

SEQ ID NO: 21380 - DNA, 355 bp, Artificial
  Mutation in BnaC.FAD2.a introduced by TALE nuclease pair BnFAD2_T02
cctctcctccctcaccctttcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21381 - DNA, 356 bp, Artificial
  Mutation in BnaC.FAD2.a introduced by TALE nuclease pair BnFAD2_T02
cctctcctccctcaccctgtctcctacttcgcctggcctctctcctgggcctgccaagggtgcgtcctaaccggcgtctgggtcatagcccacgagtgcggccaccacgccttcagcgactaccagtggcttgacgacaccgtcggactcatcttccactccttcctcctcgtcccttacttctcctggaaatcatcgacgccaccattccaacactggccccctcgagagagacgaagcgtttgtccccaagaagaagtcagacatcaagtggtacggcaagtacctcaacatccctttgggacgcaccgtgatgttaacggttcagttcactctcggctggcctttgtgcctag

SEQ ID NO: 21382 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccttcggaagactggctccctcgagagagacgaagtgtttgtccccaagaagaagtcagacatcaagtggtacggcaagtacctcaacaacccgctaggacgcacggtgatgctaaccgtccagttcactcccggctggcctttgtacgtag

SEQ ID NO: 21383 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21384 - DNA, 352 bp, Artificial
  Mutation in BnaC.FAD2.a introduced by TALE nuclease pair BnFAD2_T02
cctctcctccctcaccctctctcctacttctcctggcctctctactgggcctgccaagggcgcgtcctaaccggcgtctgggtcatagcccacgagtgcggccaccacgccttcagcgactaccagtggctggacgacaccgtcggtctcatcttccactccttcctcctcgtcccttacttctccagtcatcgacgccaccattccaacactggctccctcgagagggatgaagtgttcgtccccaagaagaaatccgacatcaagtggtccgtaaattcccccaccacctcgctaggacgtacggtgatgctacccgtccagttcccgctcggctggcctttgtacttag

SEQ ID NO: 21385 - DNA, 332 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21386 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21387 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtttcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgatcggctggcctttgtacttag

SEQ ID NO: 21388 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggacatagcccacgagtgcggccaccacgccttcagcgactaccagtggcttgacgacaccgtcggtctcatcttccactccttcctcctcgtcccttacttctcctggaagtcagccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 21389 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21390 - DNA, 357 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21391 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccattacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21392 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21393 - DNA, 393 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21394 - DNA, 309 bp, Artificial
  Mutation in BnaC.FAD2.a introduced by TALE nuclease pair BnFAD2_T02
cctctcctcctaaccctctctcctacttcgcctggcctctctactgggcctgccaagggtgcgtcctaaccggcgtctgggtcatagcccacgagtgcggccaccacgccttcagcgactaccagtggcttgacgacaccgacggtcatcgacgccaccattccaacactggctccctcgagagagacgaagtgtttgtccccaagaagaagtcagacatcaagtggtacggcaagtacctcaacaacccttaggaacgcaccgtgatgataacggttcagttcactctcggctggcctttatacttag

SEQ ID NO: 21395 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21396 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctctagagagacgaagtgtttgtccccaagaagaagtcagacatcaagtggtacggcaagtacctcaacaaccctttgggacgcaccgtgaggttaacggttcagttcacgctcggctggcctttgtgcttag

SEQ ID NO: 21397 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttag

SEQ ID NO: 21398 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctggatcatagcccacgagtgcggccaccacgccttcagcgactaccagtggcttgacgacaccgtcggtctcatcttccactccttcctcctcgtcccttacttctccttgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21399 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 21400 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtctccaagaagaagtcagacatcaagtggtacggcaagtacctcaacaaccctttgggacgcaccgtgatgttaacggttcagttcactctcggctggcctttgtacttag

SEQ ID NO: 21401 - DNA, 346 bp, Artificial
  Mutation in BnaC.FAD2.a introduced by TALE nuclease pair BnFAD2_T02
cctctcctccctcaccctctctcctacttcgcctggcctctctcctcggcctgccaagggtgcgtcctaaccggcgtctgggtcatagcccacgagtgcggccaccacgccttcagcgactaccagtggcttgacgacaccgtcgatctcatcttccactccttccccctcgtcccttacagtcatcgacgccaccattccaacactggctccctcgagagagacgaagtgtttgtccccaagaagaagtcagacatcaagtggtacggcaagttcctcagcatccgttttggacggaccctggggttaacggttcagttcacgctcggctggcctttgtacttag

SEQ ID NO: 21402 - DNA, 396 bp, Artificial
  Mutation in BnaC.FAD2.a introduced by TALE nuclease pair BnFAD2_T02
cctctcctccctcaccctctcccttacctcgcctggcccctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccccacggcttgaccccccagcaggtggtggccatcgccattctccagtcatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacgtag

SEQ ID NO: 21403 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaaatccgacatcaagtggtacggaaagtacctcaacaacccgctagaacgcacggtgatgctaaccgtccagttcacgctcggctggcctttatacttag

SEQ ID NO: 21404 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacgccaagtacctcaacagccgtttgggacgcaccgaggtgttaacggctcagttcggtctcgggtggcctttgtacttag

SEQ ID NO: 21405 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccgtcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21406 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21407 - DNA, 321 bp, Artificial
  Mutation in BnaC.FAD2.a introduced by TALE nuclease pair BnFAD2_T02
cctctcctctctcaccctctctcctacttcgcctggcctctctactgggcctgccaagggtgcgtcctaaccggcgtctgggtcatcgcccacgaatgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaaccctttgggacgcaccgggaggttaacggttcagttcactctcggctggcctttgtacttag

SEQ ID NO: 21408 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccctttgtacttag

SEQ ID NO: 21409 - DNA, 469 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcgtaacgggcctctgggtcatcgcccacgaatgcggccaccacgccttcagcgactaccagtggcttgacgacaccgtcggtctcatcttccactccttcctcctcgtcccttacttctcctggaagtgcgccgttaccaccgctgcgttcggtcaaggttctggaccagttgcgtgagcgcatacgctacttgcatacttgacagcgacggtccctaacgctgccgggtgttggcttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21410 - DNA, 423 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtagttaggccaccacttcaagaactctgtagcaccgcctacatacctcgctctgctaatcctgttagccatcgacgccaccattccaacaccgaatccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 21411 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcacgctcggctggcctttgtacttag

SEQ ID NO: 21412 - DNA, 360 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 21413 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctgtgggacgcacggtgatgttaacggttcagttcactctcggctggcctttgtacttag

SEQ ID NO: 21414 - DNA, 455 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaccgtctccagcgcctgcttgccaccattattgctggcgatggccaccacctgctggggggtcaagccgtgggcctggcacagcaccggcaacagccgcttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 21415 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 21416 - DNA, 319 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacatccctttgggacgcaccgtgatgttaacggttcggttcacgctcggctggcctttgtacttag

SEQ ID NO: 21417 - DNA, 303 bp, Artificial
  Mutation in BnaC.FAD2.a introduced by TALE nuclease pair BnFAD2_T02
cctctcctccctcaccctctctcctacttcgcctggcctctctactgggcctcccaagggtgcgtcctcaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccatgatgttaacggttcagttcactctcggctggcctttgtacttag

SEQ ID NO: 21418 - DNA, 357 bp, Artificial
  Mutation in BnaC.FAD2.a introduced by TALE nuclease pair BnFAD2_T02
cctctcctccctcaccctctctcctgcttcgcctggcctctctactgggcttcccaagggcgcgccctaaccgccgtctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacagcaagtggtacggcaagtagcccaacgcgcctgtgggacgcacgagacggctaaccgttccgttccctctcggctggcctttgtacttag

SEQ ID NO: 21419 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaacccgctaggacgcacggtgaggctaaccgtccagttcacgctcggctggcctttgtacttag

SEQ ID NO: 21420 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtcttggtcatagcccacgagtgcggccaccacgccttcagcgactaccagtggcttgacgacaccgtcggtctcatcttccactccttcctcctcgtcccttacttctcctggaagtaggcgctaaatgaaaccttaacgctatggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21421 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtccggccaccacgccttcagcgactaccagtggcttgacgacaccgtcggcctcatcttccactccttcctcctcgtcccttacttcttcatcgacgccaccattccaacactggctccctcgggagagacgaagtgtttgtccccaagaagcagtcagccatcaaatggtccgccaagtacctcaacaaccctttgtgactggccgtgaggttaacggttcagttcactgtcggctggcctttatccatag

SEQ ID NO: 21422 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagccatcgacgccaccattccaacaccggatccctcgagagggatgaagtgttcgtccccaagaagaaaccccacatcaagtggtacggaaagtacctcaacatccctgtgggacgcaccgtggttttaacggttcggttcacgctcggctggcctttgtacttag

SEQ ID NO: 21423 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21424 - DNA, 417 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacgtctccagcggctgttgccggtgctgtgccaggcccacggcttgaccccggagcaggtggtggccatcgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21425 - DNA, 350 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgatgacaccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21426 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21427 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaaatacctcaacaaccctttgggacgcaccgtgatgttaacggttcagttcactctcggctggcctttgtacttag

SEQ ID NO: 21428 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcctcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21429 - DNA, 359 bp, Artificial
  Mutation in BnaC.FAD2.a introduced by TALE nuclease pair BnFAD2_T02
cctatcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 21430 - DNA, 446 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatgttgccgctggaccagcggtggtttgtttgccggatcaagacctaccaactctttttccgaaggtaactggcttcagcagagcacagtcatcgacgccaccattccaacactggcttcctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21431 - DNA, 310 bp, Artificial
  Mutation in BnaC.FAD2.a introduced by TALE nuclease pair BnFAD2_T02
cctctcctccctcaccctctctcctacttcgcctggcctctctactggacctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21432 - DNA, 356 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21433 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagggggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21434 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 21435 - DNA, 392 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtgggcctggcacagcaccggcaagcaggcgctggagtcatcgacgccaccattccaacactggctccctcgagtgagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 21436 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgccctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacaccaagtggtacggcaagtacctcaacagccctgtgggacgcgccgtgatgttaacggttcagttcactctcggctggcctttgtacttag

SEQ ID NO: 21437 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctggggcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaactacctcaacatccgttttggacgcaccgtgatgttaacggctcagttcactctcggctgccaattgtacttag

SEQ ID NO: 21438 - DNA, 341 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21439 - DNA, 358 bp, Artificial
  Mutation in BnaC.FAD2.a introduced by TALE nuclease pair BnFAD2_T02
cctctcctccctcaccctctctcctacttcgtctggcctctctactgggccagccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggctagtacctcaacgaccctttgggacacaacggactgttaccggttcagttcactctcggctggcctttgtacttag

SEQ ID NO: 21440 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21441 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcttggctggcctttgtacttag

SEQ ID NO: 21442 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaaatccgacatcaagtggtacggaaagtacctcaacaacccgctaggacgcgcggtgatgctaaccgtccatttcacgcgcggctagcattagtacttag

SEQ ID NO: 21443 - DNA, 469 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgcgccgttaccaccgctgcgttcggtcaaggttctggaccagttgcgtgagcgcatacgctacttgcatacttgacagcgacggtccctaacgctgccgggtgttggcttagtcatcgacgccaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 21444 - DNA, 359 bp, Artificial
  Mutation in BnaC.FAD2.a introduced by TALE nuclease pair BnFAD2_T02
ccttcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21445 - DNA, 356 bp, Artificial
  Mutation in BnaC.FAD2.a introduced by TALE nuclease pair BnFAD2_T02
cctctcctccctcaccctctctcctacttcgcctggcctctatactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21446 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 21447 - DNA, 357 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcttcccttacttctcctggaatgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactcgcggctggcctttgtacttag

SEQ ID NO: 21448 - DNA, 319 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacatcgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21449 - DNA, 319 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttttacttag

SEQ ID NO: 21450 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21451 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21452 - DNA, 303 bp, Artificial
  Mutation in BnaC.FAD2.a introduced by TALE nuclease pair BnFAD2_T02
cctctcctccctcatcctctctcctacttcgcctggcctctctactgggcctgccaagggtgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21453 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 21454 - DNA, 357 bp, Artificial
  Mutation in BnaC.FAD2.a introduced by TALE nuclease pair BnFAD2_T02
cctctcctccctcaccctctctcctacttcgcctggcctctctactgggcctcccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21455 - DNA, 395 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagttgaccccccagccggtggtggccatcgccagccaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21456 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 21457 - DNA, 321 bp, Artificial
  Mutation in BnaC.FAD2.a introduced by TALE nuclease pair BnFAD2_T02
cctctcctccctcaccctctctcctacttcgccttgcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaacccttggggacgcgccgtgatgttaacggttcagttcactctcggctggcctttgtacttag

SEQ ID NO: 21458 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccgccactccaacactggctccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 21459 - DNA, 409 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaccttgaccgaacgcagcggtggtaacggcgcagtggcggttttcatggcttgagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21460 - DNA, 339 bp, Artificial
  Mutation in BnaC.FAD2.a introduced by TALE nuclease pair BnFAD2_T02
cctctcctccctcaccctctctcctacctcgcctggcctctctactggacctgccaagggtgcgtcctaaccggcgtctgggtcatagcccacgagtgcggccaccacgccttcagcgactaccagtggcttgacgacaccgtcggtctcatcttccactccttcctcctcgtcccttacgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 21461 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21462 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21463 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtaccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21464 - DNA, 356 bp, Artificial
  Mutation in BnaC.FAD2.a introduced by TALE nuclease pair BnFAD2_T02
cctctcctccccaccctctctcctacttcgcctggcctctctactgggcctgccaagggtgcgtcctaacgggcctctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21465 - DNA, 359 bp, Artificial
  Mutation in BnaC.FAD2.a introduced by TALE nuclease pair BnFAD2_T02
cctctcctccctcaccctctctcctacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21466 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21467 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 21468 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagggatgaagtgttcgtcccaagaagaaatccgacatcaagtggtacggaaagtacctcaacaacccgctaggacgcacggtgatgctaaccgtccagttcacgctcggctggcctttgtacttag

SEQ ID NO: 21469 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacaccacgtggtccggcaagtaccccaacacccctgtgggacgcaccgtgatgttaacggttcagttcactctcggctggcctttgtccttag

SEQ ID NO: 21470 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 21471 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttcacgacaccgtcggtcacatcttccactccttcctcctcgtcccttacttctcctggaagtcatcgacgcctccattccaacactggctccctcgagagagacgaagtgttcgtccccaagaacaagtctggcatcgagtggttcgggaggtacctcagcgtgcctctaagacggagggtggggcttaccccccggttgacgctccgctggccttagtgcttag

SEQ ID NO: 21472 - DNA, 414 bp, Artificial
  Mutation in BnaC.FAD2.a introduced by TALE nuclease pair BnFAD2_T02
cctctcctccctcaccctctcccttacctcgcctggcctctctactcggcctgccaagggtgcgtcctaaccggcgtctgggtcatagcccacgagtgcggccaccacgccttcagcgactaccagtggcttgacgacaccgtcggtctcatcttccactccttcctccgcgtcccttacttctcctggagaccccccagcaggtggtggccatcgccagcaataatggtggcaagcaggcgctggagagtcatcgacgccaccattccaacactggctccctcgagagagacgaagtgtttgtccccaagaagaagtcagacatcaagtggtacggcaggtagctcaacatccctgagggacgcaccgtgaggtttacgcttcagttcacgctcggctggcctttgtacttag

SEQ ID NO: 21473 - DNA, 395 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaagccgccggagtaggccttggtgtccacgatcacgccgtagtcatcgacgccaccattccaacactggctccctcgagagagacgaagtgtttgtccccaagaagaaatccgacatcaagtggtacggaaagtacctcaacaacccgctaggacgcaccgtgatgttaacggttcagttcactcgcggctggcctttgtacttag

SEQ ID NO: 21474 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21475 - DNA, 363 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21476 - DNA, 354 bp, Artificial
  Mutation in BnaC.FAD2.a introduced by TALE nuclease pair BnFAD2_T02
cctctcctccctcaccctctctcctacttcgcctggcctccctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaattacctcaacaaccctttgggacgcaccgtgatgttaacggttcatttcactctcggctggcctttgtacttag

SEQ ID NO: 21477 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 21478 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctcaccggagtctgggtcatcgcccacgagtgcggccaccacgccttcagcgactaccagtggcttgacgacaccgtcggtctcatcttccactccttcctcctcgtcccttacttctcctggaatgtcatcgacgccaccattccaacactggctccctcgagagagacgaagtgtttgtccccaagaagaagtcagacatcaagtcgtacggcaattaccccaacaaccctttggtacgcacggggatgttaacggttcagttccctctcggctggcctttgtacttag

SEQ ID NO: 21479 - DNA, 443 bp, Artificial
  Mutation in BnaC.FAD2.a introduced by TALE nuclease pair BnFAD2_T02
cctctcctccctcaccctctctcctacttcgcctggccactctactgggactgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtgcaatgcactgacgggtgccccgctcaacttgacccctctccagcgcctgcttgccgcaatcgtggctggcgagggccaccaccagtcatcgacgccaccattccaacactggctccctcgagagagacgaagtgtttgtcgccaagcagaagtcagacatcaagtggcctgtctagtcctcggccgccccagtggggtgtaagggaaagccaccgctccatttccctctcggctggcctttgtacttag

SEQ ID NO: 21480 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctaggtcatagcccacgagtgcggccaccacgccttcagcgactaccagtggcttgacgacaccgtcggtctcatcttccactccttcctcctcgtcccttacttctcctggaagtgagtcacgttatgacccccgccgatgacgcgggacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21481 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggctccctcgagagagacgaagtgtttgtccccaagaagaagtcagacatcaagtggtacggcaagtacctcaacaaccctgggggacgcaccgtgatgttaacggttcagttcactctcggctggccttcgtacttcg

SEQ ID NO: 21482 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 21483 - DNA, 331 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtaaggcaagtacctcaacaaccctttgggacgcaccgtgatgttaacggttcagttcactctcggctggcctttgtacttag

SEQ ID NO: 21484 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgtgtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21485 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagtcatcgacgccacaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21486 - DNA, 352 bp, Artificial
  Mutation in BnaC.FAD2.a introduced by TALE nuclease pair BnFAD2_T02
cctctcctccctcaccctctctcctacttcgcctggccactctactgggcctgccaagggtgcgccctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21487 - DNA, 473 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccacggcttgaccccggagcaggtggtggccatcgccagccacgatggcggcaagcaggcgctggagacggtccagcggctgttgccggtgctgtgccaggcccacggcttgaccccccagcaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21488 - DNA, 354 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21489 - DNA, 382 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgaaaccgtcggtctcatcttccactccttcctcctcgtcccttacttctcctggaagtctccagcggctgttgccggtgccggtcctcgacgccaccagtccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 21490 - DNA, 350 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21491 - DNA, 347 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21492 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 21493 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagccactaccagtggcttgacgacaccgtcggtctcatcttccactccttcctcctcgtcccttacttctcctggaagtagccatcgacgccaccattccaacaccggatccctcgagagagacgaagtgtttgtccccaataagaagtcagacatcaagtggtacggcaggtacctcagcaaccctttgggacgcaccgtgattttaacggttcagttcactctcgcctggcctttgtacttag

SEQ ID NO: 21494 - DNA, 358 bp, Artificial
  Mutation in BnaC.FAD2.a introduced by TALE nuclease pair BnFAD2_T02
cctctcctccctcaccctctctcctacttcgcctggcctctatactgggcctgccaagggtgcgtcctaaccggcgtctgggtcatagcccacgagtgcggccaccacgccttcagcgactaccagaggcttgacgaaaccgtcggtctcatcttccactccttcctcctcgtcccttacttctcctggaacagtcatcgacgccaccattccaacactggctccctcgagagagacgatgtgtttgtccccaagaagaagttagacatcaagtggtacggcaagtacctcaacaacccgttgggacgctcggtgatgttaacggttcagttcactctcggctggcctttgtacttag

SEQ ID NO: 21495 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 21496 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggtctcatcttccactccttcctcctcgtcccttacttctcctggaagttggttgtcatcgaggccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21497 - DNA, 357 bp, Artificial
  Mutation in BnaC.FAD2.a introduced by TALE nuclease pair BnFAD2_T02
cctctcctccctcaccctctctcctacttcgcctggcctcgctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaacccttagggacgcacagtgatgtgaacggttcagttcactctcggctggcctttgtacttag

SEQ ID NO: 21498 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacaccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21499 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcgtctgggtcatagtccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacatccctttgggacgcaccgtgatgttaacggttcagttcacgctcggctggcctttgtacttag

SEQ ID NO: 21500 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcaacgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21501 - DNA, 357 bp, Artificial
  Mutation in BnaC.FAD2.a introduced by TALE nuclease pair BnFAD2_T02
cctctcctccctcaccctctcccttacctcgcctggcccctctactgggcctgcccaggctgcgtcctaacgggcctctgggtcatcgcccacgaatgcgtccaccacgccttcagcgactaccagtggcttgacgacaccgtcggtctcctcttccactccttcctcctcgtcccttacttctcctggaaagtcatcgacgccaccattccaaccctggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21502 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagggatgaagtgttcgtccccaagaagaaatccgccatcaagtggtccggaaagtacctcaacaacccgctaggacgcccggtgacgctatccgtccagttcacgatcggctggcctttgtacttag

SEQ ID NO: 21503 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21504 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtacgtcctaaccggcgtctgggtcatagcccacgagtgcggccaccacgccttcagcgactaccagtggcttgacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21505 - DNA, 396 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccccacggcttgaccccccagcaggtggtggccatcgccattctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 21506 - DNA, 382 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtctccagcggctgttgccggtgccagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21507 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaacccgctaggacgcacggtgattctaaccgtccagttcacgctcggctggcctttgtacttag

SEQ ID NO: 21508 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 21509 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagacatcaagtggtacggcaagtaccgcaacatccctttgggacgcaccgtgatgttaaccgtccagttcacgcgcggctggcctttgtacttag

SEQ ID NO: 21510 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttggttgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21511 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21512 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21513 - DNA, 354 bp, Artificial
  Mutation in BnaC.FAD2.a introduced by TALE nuclease pair BnFAD2_T02
cctctcctccctcaccctctcccttacctcgcctggccactctactgggcctgccaaggctgcgtcctaacggccctctgggtcatcgcccacgaatgcggccaccacgccttcagcgaccaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactttcggctggcctttgtacttag

SEQ ID NO: 21514 - DNA, 353 bp, Artificial
  Mutation in BnaC.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21515 - DNA, 407 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaattccgactgggcctttcgttttatttgatgcctggcagttccctactctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21516 - DNA, 357 bp, Artificial
  Mutation in BnaC.FAD2.a introduced by TALE nuclease pair BnFAD2_T02
cctctcctccctcaccctctctcctacttcgcctggcctctctactgggtctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21517 - DNA, 439 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcctcttccactccttcctcctcgtcccttacttctcctggaagtgccggtgctgtgccaggcccacggcttgaccccggagcaggtggtggccatcgccagccacgatggcggcaagcaggcgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21518 - DNA, 291 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21519 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgaccccaagaagaagtcagacatcaagtggtacggcaagtacctcaacagccctttgggacgcaccgtgatgttaacggttcagttcactctcggctggctttgtacttag

SEQ ID NO: 21520 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 21521 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcacgcgcggctggcctttgtacttag

SEQ ID NO: 21522 - DNA, 322 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 21523 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21524 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctgggcgctcggtcgttcggctgcggcgagcggagtcatcgacgccaccattccaacactggctccctcgagagagacgaagtgtttgtccccaagaagaagtcagacatcaagtggtacggcaagtaccccaacaaccctttgggacgcaccgtgatgttaacggttcagttcactctcggctggcctttgtacttag

SEQ ID NO: 21525 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggaaagtaccccaacaacccgctaggacgcacggggaagctaaccgtccagttcacgcgcggctggcctttgtacttag

SEQ ID NO: 21526 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacaccggatccctcgagagagacgaagtgtttgtccccaagaagaaatccgacatcatgtggtacggaaagtacctcaacaacccgctaggacgcacggtgatgctaaccgtccagttcacgctcggctggcctttgtacttag

SEQ ID NO: 21527 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21528 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacggagtgtttgtccccaagaagaagtcagacatcaagtggtacggcaagtacctcaacaaccctttgggacgcaccgtgatgttaacggttcagttcactctcggctggcctttgtacttag

SEQ ID NO: 21529 - DNA, 357 bp, Artificial
  Mutation in BnaC.FAD2.a introduced by TALE nuclease pair BnFAD2_T02
cctctcctccctcaccctctctcctacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21530 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcacacacccagtggtacggcaagtacctcaacaaccctttgggacgcaccgtgatgttaacggttcagttcactctcggctggcctttgtacttag

SEQ ID NO: 21531 - DNA, 439 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccggtgctgtgccaggcccacggcttgaccccggagcaggtggtggccatcgccagccacgatggcggcaagcaggcgcagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 21532 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 21533 - DNA, 357 bp, Artificial
  Mutation in BnaC.FAD2.a introduced by TALE nuclease pair BnFAD2_T02
cctctcctccctcaccctctcccttacctcggctgggctctatactgggcctgccaagggtgcgtcctaaccggcgtctgggtcatagaccacgagtgcggccaccacgccttcagcgactaccagtggcttgacgacaccgtcggtctcatcttccactcattcctcctcgtcccttacttctcctgcaaagccatcgacgccaccattccaacaccggagccctcgagagggatgaagtgttcgtccccaagaagaaatcccacaccaagtggtacggcaagtacctcaacgaccctttgggacgcaccgtgatgttaacggttcagttcactctcggctggcctttttacttag

SEQ ID NO: 21534 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagctactaccagtggcttgacgacaccgtcggtctcatcttccactccttcctcctcgtcccttacttctcctggatcgacgccaccattccaatactggctccctcgagagagacgaagtgtttgtccccaagaagaagtcaaacatcaagtggtacggcatgtacctcaacaaccctttgggacgcaccgtgatgttaacggttcagttcactctcggctggcctttgtacttag

SEQ ID NO: 21535 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgagtacttag

SEQ ID NO: 21536 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 21537 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 21538 - DNA, 357 bp, Artificial
  Mutation in BnaC.FAD2.a introduced by TALE nuclease pair BnFAD2_T02
cctctcctccctcaccctctcacctacttcgcctggcatctctactgggcctgccaagggtgcgtcctaaccggcgtctgggtcatagcccacgagtgcggccaccacgccttcagcgactaccagtggattgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactcgcggctggcctttgtacttag

SEQ ID NO: 21539 - DNA, 359 bp, Artificial
  Mutation in BnaC.FAD2.a introduced by TALE nuclease pair BnFAD2_T02
cctctcctccctcaccctctctcctacttcgcctggtctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctgtgggacgcacggtgatgttaacggttcagttcactctcggctggcctttgtacttag

SEQ ID NO: 21540 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21541 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtaccgcagcaacccgctaggacgcacggggatgctaaccgtccagttcacgctcggctggcctttgtacttag

SEQ ID NO: 21542 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctggatcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggccttagtacttag

SEQ ID NO: 21543 - DNA, 358 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21544 - DNA, 362 bp, Artificial
  Mutation in BnaC.FAD2.a introduced by TALE nuclease pair BnFAD2_T02
cctctcctccctcaccctctctcctacttcgcctggactctctaccgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21545 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccacaacgccttcagcgactaccagtggcttgacgacaccgtcggtctcatcttccactccttcctcctcgtcccttacttctcctggagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 21546 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21547 - DNA, 351 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatcgacgccaccattccaatactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21548 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 21549 - DNA, 357 bp, Artificial
  Mutation in BnaC.FAD2.a introduced by TALE nuclease pair BnFAD2_T02
cctctcctccctcaccctctatcctacttcgcctgtactcactactgggcctgccaagggtgcgtcctcaccggcgtctgggtcatagcccacgcgtgcttccaccacgccttcagcgactaccagtggctttactaccccgtcggtctcatcttccactccttcctcctcgtcccttacttctcctggaaagtcatcgacgccaccattccgacactggctccctcgagagagacgaagtgtttgtccccaagaagaagtcatacatcaagtggtacggcaagtaccgcaacaaccctgtggtacgctccgttaggttaacgggtcagttctctcgcggctggccttggtacttag

SEQ ID NO: 21550 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactcgcggctggcctttgtacttag

SEQ ID NO: 21551 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcactctcggctggcctttgtacttag

SEQ ID NO: 21552 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgttatgttaacggttcagttcactctcggcgggcctttgtacttag

SEQ ID NO: 21553 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcaatggcggtggcaagcaggcgctggagacggtcatcgacgccaccattccaacactggctccctcgagagagacgaagtgtttgtccccaagaagaagtcagacatcaagtggtacggcaagtacctcaacaacccttggggacgcaccgtgatgtttacggttcagttcactctcggctggcctttgtacttag

SEQ ID NO: 21554 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatggtatcggttcagttctctctcggcgggccttgttacttag

SEQ ID NO: 21555 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21556 - DNA, 321 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgatggcaaccacctgctgaggggtcaagccgtgggcctggcacagcaccggcaacagccgctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21557 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtccggcaagtacctcaacaaccctgagggacgcacggtgagttttacggttcaggtcactctcggctggcctttgtacttag

SEQ ID NO: 21558 - DNA, 357 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21559 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 21560 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccttggtacttag

SEQ ID NO: 21561 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtgcggcaagtacctcaacaacccgctaggacgcacggtgatgctaaccgtccagttcacgctcggctggcctttgtacttag

SEQ ID NO: 21562 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtaccacaacaacccgctaggacgcacggtgatgctaaccgtccagttcacgtgcggctggccttgttacttag

SEQ ID NO: 21563 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgagtttatcggttcagttcactttcggctggccttggtacttag

SEQ ID NO: 21564 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccctcagcgactaccagtggcttgacgacaccgtcggtctcatcttcccctccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttag

SEQ ID NO: 21565 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcccatcttccactccttcctcctcgtccctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21566 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtccggcaagtacctcaacaaccctgtgggacgcaccgtgatgttaacggttcagttcactctcggctggcctttgtacttag

SEQ ID NO: 21567 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtgcttag

SEQ ID NO: 21568 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21569 - DNA, 291 bp, Artificial
  Mutation in BnaC.FAD2.a introduced by TALE nuclease pair BnFAD2_T02
cctctcctccctcaccctctgccttacctcgcctggcccctctactgggcctgccaatggtgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 21570 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacaccttcagcgactaccagtggctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21571 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaacccgttgggacgcaccgggatgttaacggttcaggtcactctcggctggcctttgtacttag

SEQ ID NO: 21572 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttttacttag

SEQ ID NO: 21573 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21574 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21575 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccagcacgccttcagcgactaccagtggcttgacgacaccgtcggtctcatcttccactccttcctcctcgtcccttacttctcctggaaggagtcatcgacgccaccattccaacacgggctccctcgagagagacgaggtgtttgtccccaagaagaagacagacatcaagtggtacggcaagtgccacaacaacccttagggacgcaccgtgatgttaacggttcagttcactctcggctagccgtacttag

SEQ ID NO: 21576 - DNA, 393 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagactgagcctttcgttttatctgttgtttgtcggtgaacgctcgccagcaaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 21577 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacgtag

SEQ ID NO: 21578 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 21579 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgcttgtccccaagaagaagtcagacatcaagtggtacggcaagtacctaaacaaccctttgggacgcaccgtgatgttaacggttcagttcactctcggctggcctttgtgcttag

SEQ ID NO: 21580 - DNA, 431 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtcttggtcatagcccacgagtgcggccaccacgccttcagcgactaccagtggcttgacgacaccgtcggtctcatcttccactccttcctcctcgtcccttacttctcctggaacattgctggcgatggccaccacctgctggggggtcaagccgtgggcctggcacagcaccggcaacagccgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21581 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagcaggcaatccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21582 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaatggttcagttcactctcggctggcctttgtacttag

SEQ ID NO: 21583 - DNA, 357 bp, Artificial
  Mutation in BnaC.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcagtctcggcgggcctttgtacttag

SEQ ID NO: 21584 - DNA, 402 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggactgccgctgccaagttcgagagacagcacatggacagcatcgatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21585 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagccatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 21586 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaacatcgacgccaccattccaacactggctccctcgagagagacgaagtgtttgtccccaagaagaagtcagacatcgagtggtgcgggaggtgcctcaacaaccctgtgggacgcaccgggaggttaggggtgaagttcactgtcggcgggcctgagtagttag

SEQ ID NO: 21587 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 21588 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 21589 - DNA, 351 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21590 - DNA, 321 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccagcgtctgggtcatagcccacgatggccaccacctgctgaggggtcaagccgtgggcctggcacagcaccggcaacagccgctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21591 - DNA, 387 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgtggccaccacgccttcagcgactaccagtggcttgacgacaccgtcggtctcatcttccactccttcctcctcgtcccttacttctcctgggcctggcacagcaccggcaacagccgctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21592 - DNA, 432 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagcggctgttgccggtgctgtgccaggcccacggcttgaccccccgggcccgggatccgatccaatgctatgaccatgattacgaattcccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21593 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21594 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21595 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21596 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 21597 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 21598 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaccccgctaggacgcacggtgatgctaaccgtccagttcacgctcggctggcctttgtacttag

SEQ ID NO: 21599 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21600 - DNA, 358 bp, Artificial
  Mutation in BnaC.FAD2.a introduced by TALE nuclease pair BnFAD2_T02
cctctcctccctcaccctctcgcctacttcgcctgccctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggaaagtacctcaacgacccgctaggacgcacggtgatgcttaccctcccgttcccgctcggctggcctttgtacttag

SEQ ID NO: 21601 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcggctaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcgtctggcctttgtacttag

SEQ ID NO: 21602 - DNA, 358 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgttcgtacccaagaagaaatccgacatcaagtggtacggaaagtacctcaacaacccgctaggacgcacggtgatgctaaccgtccagttcacgctcggctggcctttgtacttag

SEQ ID NO: 21603 - DNA, 442 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagcaggtggtggccatcgccagcaatggcggtggcaagcaggcgctggagacggtccagcggctgttgccggtgctgtgccaggcccagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21604 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgcgcggctggcctttgtacttag

SEQ ID NO: 21605 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggcctggcacagcaccggcaacagccgctggagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgcgcggctggcctgtgtacttag

SEQ ID NO: 21606 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagagaggccaccacgccttctgcgactaccagtggcttgacgacaccgtcggtctcatcttccactccttcctcctcgtcccttacttctcctggaatcgacgccaccattccaacactggctccctcgagagagacgaggtgtttgtccccaagaagaattcagacatcaagtggtacggcgagtacctcaacaaccctgtgggacgcaccgtgaggttaacggttcagttcactatcggctggcctttgtacttag

SEQ ID NO: 21607 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacgtcaacaaccctttgggacgcaccgtgatgttaacggttcagttcactctcggctggcctttgtacttag

SEQ ID NO: 21608 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcatcgtcccttacttctcctggaacagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 21609 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgctccgtgatgttaacggttcagttcactctcggctggcctttgtacttag

SEQ ID NO: 21610 - DNA, 358 bp, Artificial
  Mutation in BnaC.FAD2.a introduced by TALE nuclease pair BnFAD2_T02
cctctcctccctcaccctctctcctacttcgcctggcctctctaatgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttatcggttcatttcactctcggctggcctttgtacttag

SEQ ID NO: 21611 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctttcttctcctggaacagccatcgacgccaccattccaacaccggatccctcgagagagacgaagtgtttgtccccaagaagaagtcagacatcaagtggtacggcaagtacctcaacaaccctttgggacgccccgtgattttaacggttcagttcactctcggctggcctttgtacttag

SEQ ID NO: 21612 - DNA, 356 bp, Artificial
  Mutation in BnaC.FAD2.a introduced by TALE nuclease pair BnFAD2_T02
cctctcccccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21613 - DNA, 340 bp, Artificial
  Mutation in BnaC.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggcttgacgacaccgttggtctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21614 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21615 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgatgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcgccttgaggttaacggttcagttcactcgcggctggcctttgtacttag

SEQ ID NO: 21616 - DNA, 357 bp, Artificial
  Mutation in BnaC.FAD2.a introduced by TALE nuclease pair BnFAD2_T02
cctctcctccctcaccctctctcatacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21617 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 21618 - DNA, 432 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggaccgtctccagcgcctgcttgccaccgccattgctggcgatggccaccacctgctggggggtcaagttgagcgggtggtacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 21619 - DNA, 358 bp, Artificial
  Mutation in BnaC.FAD2.a introduced by TALE nuclease pair BnFAD2_T02
cctctcctccctcaccctctctcctacttcgccttgcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtttcatcgacgccaccattccaacaccggatccctcgagagggatgaagtgttcgtccccaagaagaaaaccgacatcaagtggtacggaaagtacctcaacaaccctttgggacgcaccgtgatgttatcggttcaggtcactcgtgtctggcctttgtacgtag

SEQ ID NO: 21620 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 21621 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21622 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21623 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21624 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagcaaatatttcttgtcaaaaatgctccaccatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggccttagtacttag

SEQ ID NO: 21625 - DNA, 355 bp, Artificial
  Mutation in BnaC.FAD2.a introduced by TALE nuclease pair BnFAD2_T02
cctctcctccctcaccctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21626 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 21627 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 21628 - DNA, 356 bp, Artificial
  Mutation in BnaC.FAD2.a introduced by TALE nuclease pair BnFAD2_T02
cctctcctccctcaccctctcacttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggatgttaccggttcagttcactctcggctggcctttgtacttag

SEQ ID NO: 21629 - DNA, 292 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21630 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21631 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcatcgacgccaccattccaacactggctccctcgagagagacgaagtgtttgtccccaagaagaagtcagacatcaagtggtacggcaagtacctcaacagccctgtgggacgcgccgtgagtttaacggttcagttcactctcggctggccttggtacttag

SEQ ID NO: 21632 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21633 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacgtcaagtggtacggcaagtacctcaacaaccctttgggacgcaccgtgatgttaacggttcagttcactctcggctggcctttgtacttag

SEQ ID NO: 21634 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 21635 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgaaagagacgaagtgattgtccccaagaaggagtcgaacatcgaggggtacggcgaggacctcaacaaccctttgggtcgctccgggatgttaatggttcagttcactctcggctggccattgtacttag

SEQ ID NO: 21636 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 21637 - DNA, 355 bp, Artificial
  Mutation in BnaC.FAD2.a introduced by TALE nuclease pair BnFAD2_T02
cctctcctccctcaccctctgtcctacttcgcctggcctctctcctgggcctgccaaggatgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctaggacgcacggtgattctaaccgtccaggtcacgctcggctggccttagtacttag

SEQ ID NO: 21638 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggcaccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21639 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 21640 - DNA, 443 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtaggcgatggccaccacctgctccggggtcaagccgtgggcctggcacagcaccggcaacagcgcctgcaccgtctccagtgcctagtcatcgacgccaccattccaacactggctccctcgagagagacgaagtgtttgtccccaagaagaagtcagacatcaagtggtaccgcaagtacctcaacaaccctttgggacgcaccgtgatgttaacggttcagttcactctcggctggcctttgtacttag

SEQ ID NO: 21641 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagtggtacggcaagcacctcaacaaccctttgggacgcaccgtgatgttaacggttcagttcactctcggctggcctttgtacttag

SEQ ID NO: 21642 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 21643 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21644 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgggctcatcttccactccttcctcctcgtcccttacttctcctggaaaagtcatcgacgcctccattccaacactgggtccctcgagagagacgaagtgtttgtccccaagaaggagtcggacatcaagtggtacggcaagtacctcaacaaccctttggaacgcaccgggatgttaacggttcagttcacgctcggctggcctttgtacttag

SEQ ID NO: 21645 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcactctcggctggcctttgtacttag

SEQ ID NO: 21646 - DNA, 356 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 21647 - DNA, 439 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtccagcgcctgcttgccaccgccattgctggcgatggccaccacctgctggggggtcaagccgtgggcctggcacagcaccggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21648 - DNA, 330 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21649 - DNA, 357 bp, Artificial
  Mutation in BnaC.FAD2.a introduced by TALE nuclease pair BnFAD2_T02
cctctcctccctcaccctctcccttacctcgcctgccccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagttcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 21650 - DNA, 352 bp, Artificial
  Mutation in BnaC.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggcatcgacgccaccattccaacactggctcccgcgagagagacgaagtgtttgtccccaagaagaagtcagacatcaagtggtacggcaagtacctcaacaaccctttgggacgcaccgtgatgttatcgggtcaggtcactgtcggctggccgttgtgcgtag

SEQ ID NO: 21651 - DNA, 348 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctccttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21652 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21653 - DNA, 348 bp, Artificial
  Mutation in BnaC.FAD2.a introduced by TALE nuclease pair BnFAD2_T02
cctctcctccctcaccctctctcctacttcgcctggcctctctactgggcctaccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21654 - DNA, 344 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaaatccgacatcaagtggtgcggaaagtacctcaacaacccgctaggacgcacggtgatgctaaccgtccagttcacgctcggctggcctttgtacttag

SEQ ID NO: 21655 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21656 - DNA, 355 bp, Artificial
  Mutation in BnaC.FAD2.a introduced by TALE nuclease pair BnFAD2_T02
ccttcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21657 - DNA, 323 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgctcgccgcagccgaacgaccgagaagaagtcagacatcaagtggtacggcaagtacctcaacaacccgctaggacgcacggtgatgctaaccgtccagttcacgctcggctggcctttgtacttag

SEQ ID NO: 21658 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaaggacctcaacaaccctttgggacgcaccgtgatgttaacggttcaggtcactctcggctggcctttgtacttag

SEQ ID NO: 21659 - DNA, 359 bp, Artificial
  Mutation in BnaC.FAD2.a introduced by TALE nuclease pair BnFAD2_T02
cctcttcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21660 - DNA, 441 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtgccaggcccacggcttgaccccccagcaggtggtggccatcgccggccagcaacgtcggttcgagatggcgctcgatgacagtcatcgacaccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21661 - DNA, 319 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtactgcaagtacctcaacaaccctttgggacgcaccgtgatgttaacggttcagttcactctcggctggcctttgtacttag

SEQ ID NO: 21662 - DNA, 357 bp, Artificial
  Mutation in BnaC.FAD2.a introduced by TALE nuclease pair BnFAD2_T02
cctctcctccctcaccctctctcctacttcgcctggcctctctactgagcctgcccatggtgcgtcctcaccggcgtctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaactgttacggaaaggacctcaacatcccgcgaggacagactgtgatgccacccgcccacttcacgctcggcgggcctttgtacttag

SEQ ID NO: 21663 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgaccccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21664 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtaagacatcaagtggtacggcaagtacctcaacaaccctttgggacgcaccgtgatgttaacggttcagttcactcgcggctggcctttgtacttag

SEQ ID NO: 21665 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 21666 - DNA, 356 bp, Artificial
  Mutation in BnaC.FAD2.a introduced by TALE nuclease pair BnFAD2_T02
cctctcctccctcacactctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21667 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgtgtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21668 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21669 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccgtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21670 - DNA, 364 bp, Artificial
  Mutation in BnaC.FAD2.a introduced by TALE nuclease pair BnFAD2_T02
cctctcctccctcaccctctgtcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcgcccggcctttgtacttag

SEQ ID NO: 21671 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaaccccacatcaagtggtacggaaagtacctcaacaaccgtttgggacgcaccgtgatgttaacggttcatttcactctcggctggcctttgtacttag

SEQ ID NO: 21672 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccgacactggctccctcgagagagacgaagtgtttgtccccaagaagaagtcagacatcaagtggtacggcaagtacctcaacacccctctgggacgcaccgtgatgttaacggttcagttcactctcggctggcctgtgtacttag

SEQ ID NO: 21673 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcatttgtacttag

SEQ ID NO: 21674 - DNA, 355 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaattacctcaccaccccttgtggacgcaccagactgttaccggttcagttccctctcggctggcctttgtacttag

SEQ ID NO: 21675 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21676 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggcctccacgccttcagcgactaccagtggcttgacgacaccgtcggtctcatcttccactccttcctcctcgtcccttaattctcctggacatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 21677 - DNA, 419 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttcaactccttcctcctcgtcccttacttctcctggaagtaaggtttcatttagcgcctcaaatagatcctgttcaggaaccggatcaaagagttcctccgcagtcatcgacgccaccattccaacactggctccctcgagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21678 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21679 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21680 - DNA, 362 bp, Artificial
  Mutation in BnaC.FAD2.a introduced by TALE nuclease pair BnFAD2_T02
cctctcctccatcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcttatcttccactccttcctcctcgtcccttacttctcctggaagtaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21681 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21682 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtccggcaagtacctcaacaaccctttgggacgcaccgtgatgttaacggttcagttcactctcggctggcctttgtacttag

SEQ ID NO: 21683 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgttcatcgacgccaccattccaacactggctccctcgagagagacgaagtgtttgtccccaagaagaagtcagacatcaagtggtacggcgaggacctcaacaaccgtttgggacgcaccgtgatgttaacggttcaggtcactctcggccggcctttgtacttag

SEQ ID NO: 21684 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacgtctccagcggctgttgccggtgctgtgccaggcccacggcttgaccccggagcaggtggtggccatcgccagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21685 - DNA, 379 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcgggctcatcttccactccttcctcctcgtcccttacttctcctggctccgcccccctgacgagcatcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 21686 - DNA, 347 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21687 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaaatccgacatcaagtggtacggaaagtacctcaacaaccctgtgggacgcaccgtgatgttaacggttcagttcactctcggctggcctttgtacttag

SEQ ID NO: 21688 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagacagacatcaagtggtacggcaagtacctcaacaaccctttgggacgcaccgtgatgttaacggttcagttcactctcggctggcctttgtacttag

SEQ ID NO: 21689 - DNA, 332 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 21690 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccaccattccaacactggctccctcgagagagacgaagtgtttgtccccaagaagaagtcagacatcaagtggtacggaaagtacctcaacaacccgctagggcgcacggtgatgctaaccgtccattgctcgctcggctggcctttgtacttag

SEQ ID NO: 21691 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21692 - DNA, 416 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacaggccaacttctcaagattgcaaaacgtggcggcgtgaccgcagtggaggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21693 - DNA, 413 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggcacagcaccggcaacagcgcctgcaccgtctccagcgcctgcttgccaccaatatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 21694 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccgagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21695 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21696 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 21697 - DNA, 354 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21698 - DNA, 343 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 21699 - DNA, 455 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtccagcggctgttgccaccgccattgctggcgatggccaccacctgctggggggtcaagccgtgggccgggcacagcaccggcaacaggcgctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21700 - DNA, 319 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaaatccgacatcaagtggtacggaaagtacctcaacaacccgctaggacgcacggtgatgctaaccgtccagttcacgctcggcgggcctttgtacttag

SEQ ID NO: 21701 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaacccgttgggacgcaccgggatgttaacggttcagttcactctcggctggcctttgtacttag

SEQ ID NO: 21702 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21703 - DNA, 353 bp, Artificial
  Mutation in BnaC.FAD2.a introduced by TALE nuclease pair BnFAD2_T02
cctctcctccctcaccctctcccttacctagcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 21704 - DNA, 315 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccaatggcggtggcaagcaggcgctggagccatcgacgccaccattccaacaccggatccctcgagagggatgaagtgttcgtccccatgaagaagtcagacatcaagtggtacggcaagtacctcaacatccctttgggacgcaccgtgatgttaacggttcagttctctctcggctggcctttgtacttag

SEQ ID NO: 21705 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagggatgaagtgttcgtcccaagaagaaatccgacatcaagtggtacggcaagtacctcaacaaccctttgggacgcaccgtgatgttaacggttcagttcactctcggctggcctttgtacttag

SEQ ID NO: 21706 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21707 - DNA, 358 bp, Artificial
  Mutation in BnaC.FAD2.a introduced by TALE nuclease pair BnFAD2_T02
cctctcctccctaaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccatcactggctccctcgagagagacgaagtgtttgtccccaagaagaagtcagacatcaagtggttcggcaagtacctcaacagccctttgggacgcgccgtggtgttaacggttcagttccctctctgcgggcctttgtacttag

SEQ ID NO: 21708 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21709 - DNA, 397 bp, Artificial
  Mutation in BnaC.FAD2.a introduced by TALE nuclease pair BnFAD2_T02
cctctcctccctcaccctctctcctacttcgcctggcctctctactcgtcctgccaagggcgcgtcctaaccggcgtctgggtcatagcccacgagtgcggccaccacgccttcagcgactaccagtggcttgacgacaccgtcggtctcatcttccactccttcctcctcgtcccttgcttctcctggaaatgcccgaggcatagactgtaccccaaaaaaacagtcataagtcatcgacgccaccattccaacactggctccctcgagagagacgaagtgtttgtccccaagaagaagtcagacatcaagtggtacggcaattcccccaacacccctttgggacgcaccgtgatgttaacggttccgttcactctcggctggcctttgtacttag

SEQ ID NO: 21710 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtaccatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 21711 - DNA, 356 bp, Artificial
  Mutation in BnaC.FAD2.a introduced by TALE nuclease pair BnFAD2_T02
cctctcctccctcaccctctctcctacttcccctggcccctctcttgggcttgcccacagctcgtcccaaccggcgcctgggtcatagcccacgactgcggccaccccgccttcagcgactaccagtggcttgacgacaccgtcggactcatcttccactccttcctcctcgtcccttacttctcctggaagtcatcgacgccaccattccaacactggctccctcgagagagacgaagtgtttgtccccaagaagaagacagacatcaagcgggtcggcaagtaccccaacgaccctgtggaaagcagcgtgatgttaagcgctcagttcactctcggctggcctttgtacttag

SEQ ID NO: 21712 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccttgtgggacgcgccgtgttgttaacggttccgtccactctcggctgccctttgtacttag

SEQ ID NO: 21713 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21714 - DNA, 382 bp, Artificial
  Mutation in BnaC.FAD2.a introduced by TALE nuclease pair BnFAD2_T02
cctctcctccctcaccctctatcctacttcgcctggcctctccactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtctccagcggctgttgccggtgccagtcatcgacgccaccattccaacactggctccctcgagagagacgaagtgtttggccccaagaagaaatccgacatcaagtggtacggaaagtacctcaacaacccgctaggacgcacggtgatgctaaccgtccagtgcacgctgggcgggccgtgttacttag

SEQ ID NO: 21715 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttccctctcggctggcctttgtacttag

SEQ ID NO: 21716 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgttcgtccccaagaagaaatccgacatcaagtggtacggaaaggacctcaacaacccgctaggacgcacggtgatgctaaccgtccagttcacgctcggctggcctttgtacttag

SEQ ID NO: 21717 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtcatcgacgccaccattccaacactggctccctcgagagagacgaagtgtttgtccctaagaagaagtcagacatcaagtggtacggcaagtacctcaacaaccctttgggacgcatcgtgatgttaatggttcagttcactctcggctggcctttgtacttag

SEQ ID NO: 21718 - DNA, 392 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtgcattgcgcttaccagaggaaaactagaaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21719 - DNA, 420 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccgctgccaagttcgtgagacagcacatggacagcatcgatgcctcgggcatccaagcacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21720 - DNA, 425 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccactccatgcatgcactgcctttttgcgtttctacaaactcttcctggctagcggtacgcgtattaattgcgttgcgctcactgcccgctttccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21721 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatattccactccttcctcctcgtcccttacttctcctggaaaagtcatcgacgccaccattccaacactggctccctcgagagagacgaagtgtttgtccccaagaagaagtcagccatcaagtggtacggcaagtacctcaacaacccgttgggacgcaccgtgatgttaacggttcagttcactctcggctggcctttggacttag

SEQ ID NO: 21722 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgggctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21723 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaaggacctcaacaacccgttgggacgcaccgtgatgttaacggttcaggtcactctcggctggcctttgtacttag

SEQ ID NO: 21724 - DNA, 359 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaaagccgacatcaagtggtacggaaagtgcctcaacaacccgctaggacgcacggggatgctaaccgtccaggtcacgcgcggctggccattatacttag

SEQ ID NO: 21725 - DNA, 403 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgtccacggatgcggccaccacgccttcagcgaccaccagtggcttgacgacaccatcggtctcatcttccactccttcctcctcgtcccttacttctcctggaagcaagatcgcttggcctcgcgcgcagatcagttggaagaatttgtccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21726 - DNA, 359 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21727 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21728 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21729 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21730 - DNA, 358 bp, Artificial
  Mutation in BnaC.FAD2.a introduced by TALE nuclease pair BnFAD2_T02
cctctcctccctcaccctctctcctacttcgcctagcctctctactaggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21731 - DNA, 354 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21732 - DNA, 336 bp, Artificial
  Mutation in BnaC.FAD2.a introduced by TALE nuclease pair BnFAD2_T02
cctctcctccctcaccctctctcctacttcgcctgccctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21733 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtatgggtcatagcccacgagtgcggccaccacgccttcagcgactaccagtggcttgacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21734 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcggcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttggacttag

SEQ ID NO: 21735 - DNA, 362 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctgtgggacgcgccgtgatgttaacggttcagttagctctcggctggcctttgtacttag

SEQ ID NO: 21736 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21737 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 21738 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggccatcgacgccaccatgccaacactggctccctcgagagagacgaagtgtttgtccccaagaagaaagccgacatcaagtggtacggaaaggaccgcaacaacccgctagggcgctcggtgatgctcaccggccatgtcactcttgggcggccctttgacttag

SEQ ID NO: 21739 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtccggcaagtaccccaacaagcctgtgggacacaaggtgaagtcaacggttcagttcactctcggctggcctttgtacttag

SEQ ID NO: 21740 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccattacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21741 - DNA, 322 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21742 - DNA, 289 bp, Artificial
  Mutation in BnaC.FAD2.a introduced by TALE nuclease pair BnFAD2_T02
cctctcctccctcaccctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21743 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21744 - DNA, 350 bp, Artificial
  Mutation in BnaC.FAD2.a introduced by TALE nuclease pair BnFAD2_T02
cctctcctcccaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21745 - DNA, 355 bp, Artificial
  Mutation in BnaC.FAD2.a introduced by TALE nuclease pair BnFAD2_T02
cctctcctccctcaccctatgtcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccagtccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21746 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgagtcacgttatgacccccgccgatgacgcgggacagtcatcgacgccaccattccaacactggctccctcgagagagacgaagtgtttgtccccaagaagaagtcagacatcaagtggtacggcaagtacctcaacacccctgtgggacgcaccgtgatgttaacggttcagttcactctcggctggcctttgtacttag

SEQ ID NO: 21747 - DNA, 291 bp, Artificial
  Mutation in BnaC.FAD2.a introduced by TALE nuclease pair BnFAD2_T02
cctctcctccctcaccctctctcctacttcgcctgccccccctactgggcctgccaagggtgcgtcctaaccggcgtctgggtcatagcccacgagtgcggccaccccgccttcagcgactaccagtggcttgacgacaccgtcggaagactggctccctcgagagagacgaagtgtttgtccccaagaagaaatccgacatcaagtggtacggaaagtacctcaacaacccgctaggacgcacggtggtgctaaccgtccagttcacgctcggccggcctttgtacttag

SEQ ID NO: 21748 - DNA, 379 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcgttcggctgcggcgagcggtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttggacttag

SEQ ID NO: 21749 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacaccggatccctcgagagggatgaagtgttcgtccccaagaagaagtcagacatcaagtggtacggcaagtacctcaacaaccctttgggacgcacggtgatgctaaccgtccagttcacgctcggctggcctttgtacttag

SEQ ID NO: 21750 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagtccacgagtgcggccaccacgccttcagcgactaccagtggcttgacgacaccgtcggtctcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21751 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21752 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttggacttag

SEQ ID NO: 21753 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcatcgacgccaccattccaacactggctccctcgagagagacgaagtgtttgtccccaagaagaagtccgacatcaagtggtacggcaagtacctcaacaacccgttgggacgcaccgtgatgttaacggttcagttcactctcggctggcctttgtacttag

SEQ ID NO: 21754 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcgaccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggcctttgtacttag

SEQ ID NO: 21755 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21756 - DNA, 414 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagaccccccagcaggtggtggccatcgccagcaataatggtggcaagcaggcgctggagagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21757 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacatccctttgggacgcactgtgatgttaacggttcagttcactctcggctggcctttgtacttag

SEQ ID NO: 21758 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccgttgggacgcaccgggatgttaacggttcagttcactctcggctggcctttgtacttag

SEQ ID NO: 21759 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgagtcctaaccggcgtctgggtcatagcccacgagtgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21760 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtctgtccccaagaagaagtcagacatcaagtggtacggcaagtacctcaacaaccctttgggacgcaccgtgatgttaacggttcagttcactctcggctggcctttgtacttag

SEQ ID NO: 21761 - DNA, 411 bp, Artificial
  Mutation in BnaC.FAD2.a introduced by TALE nuclease pair BnFAD2_T02
cctctcctccctcaccctctctcctacctcgcctggcccctctactgggcctgccaaggctgcgtcctaacgggcctctgggtcatcgcccacgaatgcggccaccgcgccttcagcgaccaccagtggcttgacgacaccgtcggtctcatcttccactccttcctcctcgtcccttacttctcctggtggcaagcaggcgctggagacggtccagcggctgttgccggtgctgtgccaggcccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21762 - DNA, 354 bp, Artificial
  Mutation in BnaC.FAD2.a introduced by TALE nuclease pair BnFAD2_T02
cctctctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21763 - DNA, 351 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggatcgacgccaccattccaatactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 21764 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccactagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 21765 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21766 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgtgaacggttcagttcactctcggctggcctttgtacttag

SEQ ID NO: 21767 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaaggacctcaacacccctgtgggacgcaccgtgatgttatcggttcaggtcactcgtgggtggcctttgtacgtag

SEQ ID NO: 21768 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgttgggacccaccgtgatgttaacggttcatttcactctcggctggcctttgtacttag

SEQ ID NO: 21769 - DNA, 336 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactatcagtggcttgatgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 21770 - DNA, 392 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtgggcctggcacagcaccggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21771 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggcagtcatcgacgccaccattccaacaccggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21772 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgtagtcatcgacgcctccattccaacactcgctccctcgagagagacgaagtgtttgtccccaagaagaagtcagacatcaagtggtacggcaagtacctcaacaacccttttggacgcaccgtgatgttaaccgttcagttcacgctcggctggcctttgtacttag

SEQ ID NO: 21773 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagaaatcaagtggtacggcaagtacctcaacaaccctttgggacgcaccgtgatgttaacggttcagttcactcgcggctggcctttgtacttag

SEQ ID NO: 21774 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagttgtacggaaagtacctcaacaacccgctaggacgcacggtgatgctaaccgtccagttcacgctcggctggcctttgtacttag

SEQ ID NO: 21775 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactcgcggctggcctttgtacttag

SEQ ID NO: 21776 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgctcgccatgcatgcactgcctcccctgcggtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21777 - DNA, 453 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagcgcaacggctgttgccggtgctgtgccaggcccacggcttgaccccccagcaggtggtggccatcgccagcaatggtggtggcaagcaggcgctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctctgctggccttggtacttag

SEQ ID NO: 21778 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggccgcatcttccactccttcctcctcgtcccttacttctcctggatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21779 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 21780 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggcgggcctttgtacttag

SEQ ID NO: 21781 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaccccttttggacgcaccgtgatgttaacggttcagttcactctcggctggcctttgtacttag

SEQ ID NO: 21782 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaacaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 21783 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagtttactctcggctggcctttgtacttag

SEQ ID NO: 21784 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21785 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtccctcaacacccctttgggacgcaccgtgatgttaacggttcagttcactctcggctggcctttgtacttag

SEQ ID NO: 21786 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcttcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 21787 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgcctttagcgactaccagtggcttgacgacaccgtcggtctcatcttccactccttcctcctcgtcccttacttctcccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 21788 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21789 - DNA, 423 bp, Artificial
  Mutation in BnaC.FAD2.a introduced by TALE nuclease pair BnFAD2_T02
cctctcctccctcaccctctcccttacctcggctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatagtcttccgactgagcctttcgttttatttgatgcctggcagttccctactctcgcgttcgaatacatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21790 - DNA, 455 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgacggtccagcgcctgcttgccggggctgtgccaggcccacggcttgaccccccagcaggtggtggccatcgccagcaatggcggtggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21791 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21792 - DNA, 389 bp, Artificial
  Mutation in BnaC.FAD2.a introduced by TALE nuclease pair BnFAD2_T02
cctctcctccctcaccctctctcctacttcgcctggcctctctcctgggcctgccagggatgcgtcctaaccggcgtctgggtcatagcccacgagtgcggccaccacgccttcagcgactaccagtggcttgacgacaccgtcggtctcatcttccactccttcctcctcgtcccttacttctcctggaagtacagcaacgtcggttcgagatggcgctcgaagtcatcgacgcctccattccaacactggctccctcgagagagacgaagtgtttgtccccaagaagaagtcagacatcgagtggtacggcgggttgctcaacgtccgtttgggacgcagtgtggggttaagggttcgggtcaggcccggccggcctttgcgcttag

SEQ ID NO: 21793 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21794 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21795 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 21796 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaggtcagacatcaagtggtacggcaagtacctcaacaacccgttgggacgcaccgtgatgttaacggttcagttcactctcggctggcatttatacttag

SEQ ID NO: 21797 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccgcgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21798 - DNA, 318 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21799 - DNA, 359 bp, Artificial
  Mutation in BnaC.FAD2.a introduced by TALE nuclease pair BnFAD2_T02
cctctcctccctcaccctctctcctacttcgcctggcctctctcatgggccagccaaggacgcgccctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagccagacatcaagtggtccggcaagtcccccaacacccctttgggacgcaatgggatgtaaacggttcagttccctctcggctggcctttgtacttag

SEQ ID NO: 21800 - DNA, 414 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagaccccccagcaggtggtggccatcgccagcaataatggtggcaagcaggcgctggagagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21801 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggtccagttcacgctcggctggcctttgtacttag

SEQ ID NO: 21802 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggcctggcacagcaccggcaacagccgctggagtcatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21803 - DNA, 392 bp, Artificial
  Mutation in BnaC.FAD2.a introduced by TALE nuclease pair BnFAD2_T02
cctctcctccctcaccctctctcctacttcgcctggcctctcccctcggcctgccaagggtgcgtcctaaccggcgtctgggtcatagcccacgagtgcggccaccacgccttcagcgactaccagtggcttgacgacaccgtcggtctcctcttccactccttcctcctcgccccttacttctcctggaagtgggcctggcacagcaccggcaagcaggcgctggagtcatcgacgccaccattccaacactggctccctcgagagagacgaagtgtttgcccccaataagaagtcacacatgaagtggtacggcaacttcctcagcatgcgttttggacggactgtggggtaaagggttcagttcaggctcggccggcttttgtgcttag

SEQ ID NO: 21804 - DNA, 350 bp, Artificial
  Mutation in BnaC.FAD2.a introduced by TALE nuclease pair BnFAD2_T02
cctctcctccctcaccctgtctcctacttcgcctggccactctcctgggcctgccaaggatgcgtcctaaccggcgtctgggtcatcgcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacgacaaatacctctacaacctgttgggacgcaccgtgaggttaacggtgcaggtgactcttggcggccagttgtacttag

SEQ ID NO: 21805 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagccaacgagtgcggccaccacgccttcagcgactaccagtggcttgacgacaccgtcggtctcatcttccactccttcctcctcgtccctgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21806 - DNA, 350 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21807 - DNA, 336 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21808 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21809 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctgcctttgtacttag

SEQ ID NO: 21810 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttaagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 21811 - DNA, 356 bp, Artificial
  Mutation in BnaC.FAD2.a introduced by TALE nuclease pair BnFAD2_T02
cctctcctccctcaccctctctcctacttcgcctggcctcactactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 21812 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggcgggcctttgtacttag

SEQ ID NO: 21813 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21814 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctattccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 21815 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21816 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcaaacaacaagtggtacggcaagtacctcaacaaccctttgggacgccccgtgatgttaacggttcagttcactctcggctggcctttgtacttag

SEQ ID NO: 21817 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggccatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21818 - DNA, 379 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcgttcggctgcggcgagcggtacagtcatcgacgccaccattccaacactggctccctcgagagagacgaagtgtttgtccccaagaagaagtaagacatcaagtggtacggcaagtacctcaacaaccctgtgggacgcaccgtgatgttaacggttcagttcactctcggctggcctttgtacttag

SEQ ID NO: 21819 - DNA, 357 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21820 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtcttggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21821 - DNA, 365 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaacagccatcgacgccaccattccaacaccggatccctcgagagggatgaagtgttcgtccccaagaagaaatccgacatcaagtggtacgtaaagtacctcaacaacccgctaggacgcacggtgatgctaaccgtccagttcacgctcggctggcctttgtacttag

SEQ ID NO: 21822 - DNA, 405 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatgttgccaccgccattgctggcgatggccaccacctgctggggggtcaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21823 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgttacttag

SEQ ID NO: 21824 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21825 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctaggctggcctttgtacttag

SEQ ID NO: 21826 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgagtcctaaccggcgtctgggtcatagcccacgagtgcggccaccacgccttcagcgactaccagtggcttgacgacaccgtcggcctcatcttccactccttcctcctcgtcccttacttctcctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21827 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagcgcggccaccacgccttcagcgactaccagtggcttgacgacaccgtcggtctcatcttccactccttcctcctcgtcccttacttctcctggacgccattgctggcgatggccaccacctgctggggggtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21828 - DNA, 354 bp, Artificial
  Mutation in BnaC.FAD2.a introduced by TALE nuclease pair BnFAD2_T02
cctctcctccctcaccctctcccctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21829 - DNA, 358 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgaccaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtccactctcggcggtccgttgtacttag

SEQ ID NO: 21830 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacagccctttgggacgcgccgtgatgttaacggttcagttcactctcggctggcctttgtacttag

SEQ ID NO: 21831 - DNA, 356 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcgagtacctcaacaaccctttgggacgcaccgtgatgttaacggttcagttcactctccgccggcatttgtacttag

SEQ ID NO: 21832 - DNA, 352 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21833 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccatcagcgactaccagtggcttgacgacaccgtcggaagactggctccctcgagagagacgaactgtttgtccccaagaagaagtcagacatcaagtggtacgacaagtacctcaacaaccctttgggacgcaccgtgatgttaacggttcagttcactctcggctggcctttgtacttag

SEQ ID NO: 21834 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagccaacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctatgggacgcaccgtgatgttaacggttcagttcactctcggctggcctttgtacttag

SEQ ID NO: 21835 - DNA, 355 bp, Artificial
  Mutation in BnaC.FAD2.a introduced by TALE nuclease pair BnFAD2_T02
cctctcctccctcaccctccctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21836 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 21837 - DNA, 407 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccgaagtttccaaaaggtcgttgatcaaagctcgccgcgttgtttcatcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21838 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 21839 - DNA, 402 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggactgccgctgccaagttcgagagacagcacatggacagcatcgatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21840 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21841 - DNA, 348 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 21842 - DNA, 357 bp, Artificial
  Mutation in BnaC.FAD2.a introduced by TALE nuclease pair BnFAD2_T02
cctctcctccctcaccctgtctcctacttcgcctggccactctcctcggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaaccggctaggacgcacggtgaggctaaccgtccagttcacgctcggccggcctttgtacttag

SEQ ID NO: 21843 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagatagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21844 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21845 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 21846 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtctccaagaagaagtcagacatcaagtggtacggcaagtacctcaacaaccctttgggacgcaccgtgatgttaacggttcagttcactctcggctggcctttgtacttag

SEQ ID NO: 21847 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 21848 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgactacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21849 - DNA, 357 bp, Artificial
  Mutation in BnaC.FAD2.a introduced by TALE nuclease pair BnFAD2_T02
cctctcctccctcaccctttctcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagccctttgggacgcaccgtgaggttaacggttcagttcactctcggctggcctttgtacttag

SEQ ID NO: 21850 - DNA, 331 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaaccctttgaaacgcaccgtgatgttaacggttcagttcactctctgctggcctttgtacttag

SEQ ID NO: 21851 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21852 - DNA, 383 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatctaccactccttcctcctcgtcccttacttctcctggaagtttgaccccggagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21853 - DNA, 356 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcgcgctcggctggcctttgtacttag

SEQ ID NO: 21854 - DNA, 359 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21855 - DNA, 355 bp, Artificial
  Mutation in BnaC.FAD2.a introduced by TALE nuclease pair BnFAD2_T02
cctctcctccctcaccctctctcctacttcgcctggcctctctactgggcctgcccagggtgcgtcctaaccggcgtctgggtcatagcccacgagtgcggccaccacgccttcagccactaccagtggcttgacgacaccgtcggtctcctcttccactccttcctcctcgtcccttacttctcctggaagtcatcgacgccaccattccaacactggctccctcgagagagacgaagtgtttgtccccaagaagaagtcagacagcaagtggtacggcaagtgcctcaacagccctttgggacgcaccgtggtgttagcggttcagttcgctctcggctggcctttgacttag

SEQ ID NO: 21856 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 21857 - DNA, 354 bp, Artificial
  Mutation in BnaC.FAD2.a introduced by TALE nuclease pair BnFAD2_T02
cctctcctccctcaccctctcccctacttcgcctggcctctatactgggcctgccaagggtgcgtcctacccggcgtctgggtcatagcccacgagtgcggcccccacgccttcagcgactaccagtggcttgacgacaccgtcggtctcatcttccactccttcctcctcgtcccttacttctcctggaacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggcgggccgttgtacttag

SEQ ID NO: 21858 - DNA, 359 bp, Artificial
  Mutation in BnaC.FAD2.a introduced by TALE nuclease pair BnFAD2_T02
cctctcctccctcaccctctctcctacttcgcatggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21859 - DNA, 292 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtgtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 21860 - DNA, 321 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 21861 - DNA, 352 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21862 - DNA, 357 bp, Artificial
  Mutation in BnaC.FAD2.a introduced by TALE nuclease pair BnFAD2_T02
cctctcctccctcaccctctctcctacttcgcctgtcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaagtcatcgacgccaccattccaacactggctccctcgagagagacgaagtgtttgtccccaagaagaagtcacacatcaagtggtacggcaagtacctcaacaaccctttgggacgcaccgtgatgttaacggttcagttcactctcggctggcctttgtacttag

SEQ ID NO: 21863 - DNA, 357 bp, Artificial
  Mutation in BnaC.FAD2.a introduced by TALE nuclease pair BnFAD2_T02
cctctcctccctcaccctctctcctacttcgcatggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgcgaaccgtccagttcacgctcggctggcctttgtacttag

SEQ ID NO: 21864 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 21865 - DNA, 357 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21866 - DNA, 303 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21867 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21868 - DNA, 352 bp, Artificial
  Mutation in BnaC.FAD2.a introduced by TALE nuclease pair BnFAD2_T02
cctctcctccctcaccctctctcctacttcgcctgccctctctactgggcctgccaagggtgcgtcctaaccggcgtctgggtcatagcccacgagtgcctccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaaggcagacatcaagtggtacggcaagtacttgaccgcccctttgggaggctacatgatgttaccggttcagttccctccttgcgggcctttgtacttag

SEQ ID NO: 21869 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccatcgagatagacgaagtgtttgtccccaagaagaaatccgacatcaagtggtacggaaagtacctcaacaacccgctgggacgcacggtgatgctaacggtccagttcacgctcggctggcctttgtacttag

SEQ ID NO: 21870 - DNA, 358 bp, Artificial
  Mutation in BnaC.FAD2.a introduced by TALE nuclease pair BnFAD2_T02
cctctcctccctcaccctctctcctacttcgcctggcctctctcctcggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacatccctgtgggacgcaccgtggggttaacggttcagttcacgctccgctggcctttgtacttag

SEQ ID NO: 21871 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaactgtttgtccccaagaagaagtcagacatcaagtggtacggcaagtacctcaacaacccgctaggacgcacggtgatgctaaccgtccagttcacgctcggctggcctttgtacttag

SEQ ID NO: 21872 - DNA, 356 bp, Artificial
  Mutation in BnaC.FAD2.a introduced by TALE nuclease pair BnFAD2_T02
cctctcctccctcaccctctctcctacttctcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctgtgggacgcaacgtgatgttaacggttcagttcactctcggctggcctttgtacttag

SEQ ID NO: 21873 - DNA, 400 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttactcctcgtcccttacttctcctggaagtgccaggcccacggcttgaccccggagcaggtggtggccatcgcctggcacagcaccggcaacagccgctggaccctcgagagagacgaagtgtttgtccccaagaagaagtcagacatcaagtggtacggcaagtacctcaacaaccctttgggacgcacggtgatgctaaccgtccagttcactctcggctggcctttgtacttag

SEQ ID NO: 21874 - DNA, 358 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21875 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 21876 - DNA, 336 bp, Artificial
  Mutation in BnaC.FAD2.a introduced by TALE nuclease pair BnFAD2_T02
cctctcctccctcaccctctcccttacctcgcctggccactctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21877 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttactcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21878 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagcaaatatttcttgtcaaaaatgctccaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21879 - DNA, 443 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcaggtggtggccatcgccagcaatggcggtggcaagcaggcgctggagacggtccagcggctgttgccggtgctgtgccaggcccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21880 - DNA, 332 bp, Artificial
  Mutation in BnaC.FAD2.a introduced by TALE nuclease pair BnFAD2_T02
cctctcctccctcaccctctctcctacttcgcctggcctctctactgggcctgtcaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 21881 - DNA, 359 bp, Artificial
  Mutation in BnaC.FAD2.a introduced by TALE nuclease pair BnFAD2_T02
cctctcctccctcaccctttctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21882 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgtaccgtgatgttaacggttcagttcactctcggctggcctttgtacttag

SEQ ID NO: 21883 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgaggttaacggttcagttcacgctcggctggcctttgtacttag

SEQ ID NO: 21884 - DNA, 392 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggcctggcacagcaccggcaagcaggcgctggagtcatcgacgccaccattccaacactggatccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 21885 - DNA, 343 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactatcgacgccaccattccaacactggctccctagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21886 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactacccgtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21887 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccgtacagtcatcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21888 - DNA, 358 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 21889 - DNA, 356 bp, Artificial
  Mutation in BnaC.FAD2.a introduced by TALE nuclease pair BnFAD2_T02
cctctcctccctcaccctctctcctacttcgcctgtcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtaccttacttctcctggaagtcatcgacgccaccattccaacactggctccctcgagagagacgaagtgtttgtccccaagaagaagtcagccatcaagtggtacggcaagtacctcaacaacccttttggacgccccgtgatgttaacggttcagttcactctcgtctggcctttgtacttag

SEQ ID NO: 21890 - DNA, 357 bp, Artificial
  Mutation in BnaC.FAD2.a introduced by TALE nuclease pair BnFAD2_T02
cctctcctccctcaccctctctcctacctcgcctggcctctctactgggcttgccaatgttccgtcctaaccggcgactgggtcatagcccacgtgtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtccgcgaagtccttcaacgtctataagggacgccctgtgctcctacaggctcacttcactctcggctggcctttgtacttag

SEQ ID NO: 21891 - DNA, 319 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggaaagtacctcaacaaccctttgggacgcaccgtgatgttaacggttcagttcactctcggctggcctttgtacttag

SEQ ID NO: 21892 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggctggcctttgtacttag

SEQ ID NO: 21893 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21894 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21895 - DNA, 392 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggcctggcacagcaccggcaagcaggcgctggagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21896 - DNA, 359 bp, Artificial
  Mutation in BnaC.FAD2.a introduced by TALE nuclease pair BnFAD2_T02
cctctcctccctcaccctctctcctacttcgcctggcccctctactcggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21897 - DNA, 345 bp, Artificial
  Mutation in BnaC.FAD2.a introduced by TALE nuclease pair BnFAD2_T02
cctctcctccctcaccctctcccttacctcgcctggcccctctacttggcctgccaaggctgcgtcctaacgggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaaggacctcaacaaccctttgggacgcaccgggatgttaacggttcagttcactctcggctggcctttgtacttag

SEQ ID NO: 21898 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcacacgagtgcggccaccacgccttcagcgactaccagtggcttgacgacaccgtcggtcccatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21899 - DNA, 358 bp, Artificial
  Mutation in BnaC.FAD2.a introduced by TALE nuclease pair BnFAD2_T02
cctctcctccctcatcctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21900 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctagtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21901 - DNA, 312 bp, Artificial
  Mutation in BnaC.FAD2.a introduced by TALE nuclease pair BnFAD2_T02
cctctcctccctcaccctgtctcctacttcgcctgtcttctctactgggcctgccaagggtgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacatccctttgggacgcaccgtgatgctaacggttcagttcacgctcggctggcctttgcacttag

SEQ ID NO: 21902 - DNA, 435 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtacaacgaacaggtcactatcagtcaaaataaaatcattatttgccatgtcggttcgagatggcgctcgatgacgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21903 - DNA, 357 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtacccaagaagaagtcagacatcaagtggtacggcaagtccctcaacaaccctttgggacgccccgtgatgttaacggttcagttcactctcggctggcctttgtacttag

SEQ ID NO: 21904 - DNA, 310 bp, Artificial
  Mutation in BnaC.FAD2.a introduced by TALE nuclease pair BnFAD2_T02
cctctcctccctcaccctatctcctacttcgcctggcctctctaccgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaacccgcttggacgcactgtgatgcgaaccgtccagttcacgctcggctggcctttgtacttag

SEQ ID NO: 21905 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccaccattccagcaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 21906 - DNA, 434 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatggcggcaagcgggcgctggagacggtccagcggctgttgccggtgctgtgccaggcccacggcttgaccccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21907 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21908 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtcccatcttccactccttcctcctcgtcccttacttctcctggaatcatcgacgccaccattccaacactggctccctcgagagagacgaagtgtttgtccccaagaagaagtcacacatcaagtggtacggcaattacctcaacaaccctttgggacgccccgtgatgttaacggttcagttcactctcggctggcctttgtacttag

SEQ ID NO: 21909 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgcaaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 21910 - DNA, 349 bp, Artificial
  Mutation in BnaC.FAD2.a introduced by TALE nuclease pair BnFAD2_T02
cctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21911 - DNA, 365 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaactacagtcatcgacgccaccattccaacactggctccctcgagagagacgaagtgtttgtccccaagaagaagtcagacatcaagtgttacggcaagtacctcaacaaccctttggaacgcaccgtgattttaacggttcagtccactctcggctggcctttgtacttag

SEQ ID NO: 21912 - DNA, 330 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcgccaccattccaacactggctccctcgagagagacgaagtgtttgtccccaagaagaagtcagacatcaagtggtacggcaagtacctcaacagccctgtgggacgcaccgtgatgttaacggttcagttcactctcggctggcctttgtacttag

SEQ ID NO: 21913 - DNA, 356 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 21914 - DNA, 341 bp, Artificial
  Mutation in BnaC.FAD2.a introduced by TALE nuclease pair BnFAD2_T02
cctctcctccctcaccctctctcctacttcgcctgccctctctactgggcctgccaagggtgcgtcctaaccggcgtctgggtcatagcccacgagtgcggccaccacgccttcagcgactaccagtggcttgacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctccgctggcctttgtacttag

SEQ ID NO: 21915 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacagcccgttgggacgcaccgtgaggttaacgtttcagttcactctcggctgcccttagtacttag

SEQ ID NO: 21916 - DNA, 357 bp, Artificial
  Mutation in BnaC.FAD2.a introduced by TALE nuclease pair BnFAD2_T02
cctctcctccctcaccctctcccttacctcgcctggcccctctcctcggcctgccaaggatgcgtcctaacgggcctctgggtcttcgcccacgagtgcggccaccccgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttttggacgcaccgtggtgttaacggttcagttcactctcggctggcctttgtacttag

SEQ ID NO: 21917 - DNA, 355 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatctacgccaccattccaacactggctccctcgagagagacgaagtgtttgtccccaagaagaagtcagacatcaagtggtacggcaagtacctcaacaacccggtgggacgcaccgtgatgttaacggtgcaggtcactctcggctggcctttatacttag

SEQ ID NO: 21918 - DNA, 357 bp, Artificial
  Mutation in BnaC.FAD2.a introduced by TALE nuclease pair BnFAD2_T02
cctctcctccctcaccctatcacctacttcgcctgacctctatactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatctgacatcaagtggtacggaaactgcctcaacagcccgctaggacgcacggtgatgctaaccgtccagttcacgctccgcgggcctttgtacttag

SEQ ID NO: 21919 - DNA, 344 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21920 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtccaactcatcttccactccttcctccccgtcccttacttccactggaaagtcatcgacgccaccattccaacactggctccctcgagagagacgaagtgtttgtccccaagaagaagtcagacatcaagtggtacggaaagtacctcaacaacccgctgggacgcacggtgatgttaacggtccagttcacgctcggctggcctttgtacttag

SEQ ID NO: 21921 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacctgcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacagcccttggggacgcaccgtgatgttaacggttcagttcactctcggctggccgttgtacttag

SEQ ID NO: 21922 - DNA, 358 bp, Artificial
  Mutation in BnaC.FAD2.a introduced by TALE nuclease pair BnFAD2_T02
cctctcctccctcaccctgtctcctacttcgcctggcctctctcctgggcctgccaagggtgcgtcctaacctgcgtctgggtcatagcccccgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21923 - DNA, 356 bp, Artificial
  Mutation in BnaC.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacgtcaacaacccttggggacgcgcggtaatgttaacggtgcagttcactctcggctggcatttgtacttag

SEQ ID NO: 21924 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaaggcagacatcaagtggtacggcaagtacctcaacaaccctttgggacgcaccgtgatgttaacggttcagttcacgctcggctggcctttgtacttag

SEQ ID NO: 21925 - DNA, 291 bp, Artificial
  Mutation in BnaC.FAD2.a introduced by TALE nuclease pair BnFAD2_T02
cctctcctccctcaccctctctcctacttcgcctggcctctctactgggtctgccaagggtgcgtcctaaccggcgtctgggtcatagcccacgagtgcggccaccacgccttcagcgactaccagtggctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21926 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccccgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaacgaccgcaacatccctttgggacgcaccgtggtgttaacggttcatttcactctcggctgcccttagtacttag

SEQ ID NO: 21927 - DNA, 360 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaacccttggggacgcaccgtgatgttaacggttcatttcactctcggctggcctttgtacttag

SEQ ID NO: 21928 - DNA, 428 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctccagcgcctgcttgccaccattattgctggcgatggccaccacctgctggggggtcaagccgtgggcctggcacagcacctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21929 - DNA, 353 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21930 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 21931 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 21932 - DNA, 412 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcggtggccctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21933 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttgcactccttcctcctcgtcccttacttctcctggaagtatcatcgacgccaccattccaacactggctccctcgagagagacgaagtgtttgtccccaagaagaagtcatacatcaagtggtacggcaagtacctcaacaaccctttgggacgcaccgtgatgttaacggttcagttcactctcggctggcctttgtacttag

SEQ ID NO: 21934 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctacctcgagagagacgaagtgtttgtccccaagaagaagtcagacatcaagtggtacgggaaggaccgcaacaaccctttgggaagcaccgtgatgttaacggttcagttgactctcgggtgcccgttgtacttag

SEQ ID NO: 21935 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21936 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21937 - DNA, 381 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtctccagcgcctgcttgccaccgccagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctgctttgtacttag

SEQ ID NO: 21938 - DNA, 419 bp, Artificial
  Mutation in BnaC.FAD2.a introduced by TALE nuclease pair BnFAD2_T02
cctctcctccctcaccctatctcctacttcgcctggcatctctaccaggcctgccaagggtgcgtcctaaacggcgtctgggtcatagcccacgagtgcggccaccacgccttcagcgactaccagtggcttgacgacaccgtcggcctcatcttccactccttcctcctcgtcccttacttctcctggatctccagcggctgttgccggtggtgtgccaggcccacggcttgacccctcagcaggtggtggcagtcatcgacgccaccattccaacactggctccctcgagagagacgaagtgtttgtccccaagaagaagtcagacatcaagtggtacggcaagtacctcagcaaccctttgggacgcaccgtgaggttaacggttcagttcactctcggctggcctttgtacttag

SEQ ID NO: 21939 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcatgctcggctggcctttgtacttag

SEQ ID NO: 21940 - DNA, 352 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21941 - DNA, 353 bp, Artificial
  Mutation in BnaC.FAD2.a introduced by TALE nuclease pair BnFAD2_T02
cctctcctccctcaccctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtccggcaagtaccccaacacccctgtgggacgcaccgggatgctaaccgttccgttcactctcggctggcctttgtacttag

SEQ ID NO: 21942 - DNA, 354 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21943 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcatttgtacttag

SEQ ID NO: 21944 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgggctcatcttccactccttcctcctcgtcccttacttctcctggaaagtcatcgacgccaccattccaacactggctccctcgagagagacgaagtgtttgtcaccaagaagaagtcagacatcgaggggtacggcaaggacctcaacaaccctgtgggacgcgccgtgatgttagcgtttcagttcactcgcggctagcctttgtacttag

SEQ ID NO: 21945 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21946 - DNA, 340 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtccctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21947 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcctctgggtcatcgcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 21948 - DNA, 360 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtaagtcatcgacgccaccattccaacactggctccctcgagagagacgaagtgtttgtccccaagaagaagtcagacatcaagtggtacggcaagtacctcagcaaccctttgggacgcaccgtgatgttaacggttcagttcacgctcggctggcctttgtacttag

SEQ ID NO: 21949 - DNA, 357 bp, Artificial
  Mutation in BnaC.FAD2.a introduced by TALE nuclease pair BnFAD2_T02
cctctcctccctcaccctctctcctacttcgcctgacctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaagtcatcgacgccaccattccaacactggctccctcgagagagacgaagtgtttgtccccaagaagaagtcagacatcaagtggtaaggcaagtacctcaacaacactttgggaagagccgtgatgttaacggttcagttcactctcggccggcctttgtacttag

SEQ ID NO: 21950 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 21951 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaaggcacgccaccattccaacactggctccctcgagagagacgaagtgtttgtccccaagaagaagtaagacatcaagtggtacggcaagtaccgcaacaaccctttgggacgcaccgtgatgttaacgggtcagttcactctcggctggccgttgtacttag

SEQ ID NO: 21952 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21953 - DNA, 441 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtgccaggcccacggcttgaccccccagcaggtggtggccatcgccggccagcaacgtcgggtcgagatggcgctcgatgacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21954 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21955 - DNA, 408 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaccgtcgctgtcaagtatcaggacatgatcgcagcgttgccagaggcgacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21956 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcacagtgatgttatcagttcagttcactctcggctagcatttgtacttag

SEQ ID NO: 21957 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtccggcaagtacctcaacaaccctttgggacgcaccgtgatgttaacggttcagttcacgctcggctggcctttgtacttag

SEQ ID NO: 21958 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctgggcgttgtacttg

SEQ ID NO: 21959 - DNA, 358 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21960 - DNA, 356 bp, Artificial
  Mutation in BnaC.FAD2.a introduced by TALE nuclease pair BnFAD2_T02
cctctcctccctcaccctctctcctacttcgcctcgcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtccttagtacttag

SEQ ID NO: 21961 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcactgttatgctaaccgtccagttcacgctcggctggcctttgtacttag

SEQ ID NO: 21962 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21963 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 21964 - DNA, 336 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 21965 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcttagcccacgagtgcggccaccacgccttcagcgactaccagtggcttgacgacaccgtcggtctcatcttccactccttcctcctcgtcccttacttctcctggaaggccatcgacgccaccagtccaacactggctccctcgagagagactaagtgtttgtccccaagaagaagtcagacatcgagtggtacggcaagtacctcaacaaccctgtgagacgcaccgtgaagtcaacggttcagttcacgctcggctggcctttgtacttag

SEQ ID NO: 21966 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 21967 - DNA, 354 bp, Artificial
  Mutation in BnaC.FAD2.a introduced by TALE nuclease pair BnFAD2_T02
cctctcctcctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaaatacctcaacaaccctttgggacgcaccgggatgttaacgtttcagttcactctcggctggcctgagtacttag

SEQ ID NO: 21968 - DNA, 419 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatctccagcggctgttgccggtgctgtgccaggcccacggcttgacccctcagcaggtggtggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21969 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttggaacgcaccgtgatgttaacggttcagttcactctcggctgccctttgtgcttag

SEQ ID NO: 21970 - DNA, 399 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaagtagccgaagtttccaaaaggtcgttgatcaaagctcgccgcgttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 21971 - DNA, 451 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgcatgcatggcgcaatgcactgacgggtgccccgctcaacttgaccccaagattgcaaaacgtggcggcgtgaccgcagtggaggcagtgcatgtcatcgacgccaccattccaacactggctccctcgagagagacgaagtgtttgtccccaagaagaagtcagacatcaagtggtacggcaggtaccacaacaaccctttgggacgcaccgtgaggttaacggttcagttgactcgcggctggccttagtacttag

SEQ ID NO: 21972 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattacaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 21973 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggactcatcttccactccttcctcctcgtcccttacttctcctggaagtcatcgacgccaccattccaacactggctccctcgagagagacgaagtgtttgtccccaagaagaagtcagacatcaagtggtacggcaagttcctcaacaaccctttgggacgcaccgtgatgttaacggttcagttcactctcggctggcctttgttacttag

SEQ ID NO: 21974 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaaggatgcgtcctaaccggcgtctgggtcatagcccacgagtgcggccaccacgccttcagcgactaccagtggcttgacgacaccgtcggtctcatcttccactccttcctcctcgtcccgtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 21975 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaaggacctcaacaacccgttgggacgccccgtgatgttaacgtttcagttcactctcggctggcctttgtacttag

SEQ ID NO: 21976 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcacggtgatgttaacggttcagttcacgctcggctggcctttgtacttag

SEQ ID NO: 21977 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 21978 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaaggacctcaacaacccgttgggacgcaccgtgatgttaacggttcagttcactcgcggctggccagtgtacttag

SEQ ID NO: 21979 - DNA, 356 bp, Artificial
  Mutation in BnaC.FAD2.a introduced by TALE nuclease pair BnFAD2_T02
ctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21980 - DNA, 400 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccaggcccacggcttgaccccggagcaggtggtggccatcgcctggcacagcaccggcaacagccgctggaccctcgagagagacgaagtgtttgtccccaagaagaagtcagacatcaagtggtccggcaagtacctcaacaaccctttgggacgcaccgtgatgttaacggttcagttcactctcggctggcatttgtacttag

SEQ ID NO: 21981 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcagccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 21982 - DNA, 458 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagcggtccagcggctgttgccaccatcattgctggcgctggccaccacctgctggggggtcaagccgtgggcctggcacagcaccggcaccagccgctggagagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 21983 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 21984 - DNA, 361 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtccagcggctgttgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21985 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctgccctttgtacttag

SEQ ID NO: 21986 - DNA, 455 bp, Artificial
  Mutation in BnaC.FAD2.a introduced by TALE nuclease pair BnFAD2_T02
cctctcctccctcaccctctctcctacttcgcctggccacactactgggcctgccaagggtgcgtcctaaccggcgtctgggtcatagcccacgagtgcggccaccacgccttcagcgactaccagtggcttgacgataccgtcggtctcatcttccactccttcctcctcgtcccttacttctcctggaccgtctccagcgcctgcttgccaccattattgctggcgatggccaccacctgctggggggtcaagccgtgggcctggcacagaaccggcaacagccgcttgtcatcgacgccaccattccaacactggctccctcgagagagacgaagtgtttgtccccaagaagaagtcagacatcaagtggtacggcaagtacctcaacagccctgtgggacgcaccgtgaggttatcggttcagttcgctctcggctggccgtggtacttag

SEQ ID NO: 21987 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccagcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 21988 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttccctctcggctggcctttgtacttag

SEQ ID NO: 21989 - DNA, 430 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggtgactcgagggttatttgccgactaccttggtgatcttctagtgtagccgtagttaggccaccacttcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21990 - DNA, 332 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaattacctcaacatgcctttggggcgcaccgtgatgttaacggttcagtgcacgctcgtctggccgatgtacttag

SEQ ID NO: 21991 - DNA, 353 bp, Artificial
  Mutation in BnaC.FAD2.a introduced by TALE nuclease pair BnFAD2_T02
cctctcctccctcaccctctcccttacctcgcctagcccctctactgggcctgccaaggctgcgtcctaacgggcctctgggtcatcgaccacgaatgcggccaccacgccttcagcgactaccagtggcttgacgacaccgttagtctcatcttccactccttcctcctcgtcccttacttctcctagtcatcgacgccaccattccaacactggctccctcgtgagagacgaattgtttgtccccaagaagaagtcagacatcaagtggtacggaaagtacctcaacatccctttgggacgcaccgtgatgttaacggttcagttcactctaggctggcctttgtacttag

SEQ ID NO: 21992 - DNA, 356 bp, Artificial
  Mutation in BnaC.FAD2.a introduced by TALE nuclease pair BnFAD2_T02
cctctcctccctcaccctctcccctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggatccctcgagagggacgaagtgttcgtccccaagaagaaatcagacatcaagtggtacggaaagtacctcaacaaccctctgggacgcacggtgatgttaaccgtccagttcacgctcggctggcctttgtacttag

SEQ ID NO: 21993 - DNA, 358 bp, Artificial
  Mutation in BnaC.FAD2.a introduced by TALE nuclease pair BnFAD2_T02
cctctcctccctcaccctatctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 21994 - DNA, 351 bp, Artificial
  Mutation in BnaC.FAD2.a introduced by TALE nuclease pair BnFAD2_T02
cctctcctccctcaccctctcacctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacactggctccctcgagagagacgaagtgtttgtccccatgaagaagtcagacatcaagtggtacggcaagtacctcaacagccctttgggacgcaccgtgatgttaacgggtcagttcactctcggctggcctttgtacttag

SEQ ID NO: 21995 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcgagtggtacggcgaggaccgcaacgaccctgggggacgcgccggggtgttagcgggtcggttgactctcgggtggcctgtgtacttag

SEQ ID NO: 21996 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttaacgctcggctggcctttgtacttag

SEQ ID NO: 21997 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccattacttctcctggaagtacacagtcatcgacgccaccattccaacactggctccctcgagagagacgaagtgtttgtccccaagaagaagtcagacatcaagtggtacggcaagtacctcaacaagcctttgggacgcaccgtgatgttaacggttcagttcactctcggctggtctttgtacttag

SEQ ID NO: 21998 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggaaagtacctcaacaaccctttgggacgcaccgtgatgttaacggttcagttcactctcggctggcctttgtacttag

SEQ ID NO: 21999 - DNA, 427 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtacaaggcggtaatacggttatccacagaatcaggggataacgatatcgatgctgtccatgtgctgtacagtcatcgacgccaccattccaacactggatccctcgagagggatgaagtgttcgtccccaagaagaagtcagacatcaagtggtacggcaagtacctcaacaaccctttgggacgcaccgtgatgttaacggttgagttcacgctcggctggcctttgtacttag

SEQ ID NO: 22000 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacacgggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22001 - DNA, 313 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaaatccgacatcaagtggtacggaaagtacctcaacaacccgcgaggacgcacggtgatgctaaccgtccagttcacgctcggctggcctgttgtacttag

SEQ ID NO: 22002 - DNA, 388 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagccttctgcttagtttgatgcctggcagtacagtcatcgccgccacctttccaacactggctccctcgagagagacgaagtgtttgtccccaagaagaagtcagacatcaagtggtacggcaagtacctcaacaaccctttgaaacgcaccgtgatgttaaccgttcagttcactcccggctggcctttgtacttag

SEQ ID NO: 22003 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggacatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22004 - DNA, 431 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcatcctcgtcccttacttctcctggaacattgctggcgatggccaccacctgctggggggtcaagccgtgggcctggcacagcaccggcaacagccgctggagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22005 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaaccctctaggacgcacggtgatgctaaccgcccagttcacgctcggctggcctttgtacttag

SEQ ID NO: 22006 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22007 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacagcaagtggtacggcaagtacctcaacaaccctttgggacgcaccgtgatgttaacggttcagttcactctcggctggcctttgtacttag

SEQ ID NO: 22008 - DNA, 318 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 22009 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22010 - DNA, 292 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22011 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 22012 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgagtgcggccaccacgccttcagcgactaccagtggcttgacgacaccgtcggtctcatcttccactccttcctcctcgtcccttacttctcctggaagtcagtcatcgacgcccccattccaacactggctccctcgggagagacgaagtgtttgtccccaagaaaaagtcaaccatcaggtggtacggcaagtacctcaacaccccttgggaacgcaccgggatgttaacggttcagttccctctcggctggcctttgtacttag

SEQ ID NO: 22013 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggccgttgtacttag

SEQ ID NO: 22014 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22015 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggcttgacgacaccgtcggtctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 22016 - DNA, 332 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacaccttcagcgactaccagtggcttgacgacaccgtcggtctcatcttccactccttcctcctcgtcccttacttctcctggaagtggctccctcgagagagactaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22017 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctggatcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22018 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaattcatcgacgccaccattccaacactggctccctcgtgagagacgaagtgtttgtccccaagaagaagtcagacatcaagtggtacggcaagtaccgcagcaaccctttgggacgcaccgtggtgttatcggttcagttcgctctcggctgtcctgtgtacttag

SEQ ID NO: 22019 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatcccacatcaagtggtacggaaagtacctcaacaaccctctaggacgcacggtgatgctaaccgtccagttcacgctcggctggcctttgtacttag

SEQ ID NO: 22020 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttagtccccaagaagaaatccgacatcaagtggtacggaaagtacctcaacaacccgctaggacgcacggtgatgctaaccgtccagttcacgctcggctggcctttgtacttag

SEQ ID NO: 22021 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtccgttgtacttag

SEQ ID NO: 22022 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagggctgacgtgttcgtccccaagaagaaatccgacatcaagtggtacggaaagtacctcaacaacccgctaggtcgcacggtgatgctaaccgtccagttcacgctcggctggcctttgtacttag

SEQ ID NO: 22023 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtcttggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22024 - DNA, 353 bp, Artificial
  Mutation in BnaC.FAD2.a introduced by TALE nuclease pair BnFAD2_T02
cctctcctccctcaccctctctcctacttcgcctcgcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagaagtgtttgtccccaagaagaagtcagacatcaagtggtacggcaagtacctcaacagccctttgggacgcaccgtgatgttaacggttcagttcactctcggctgtcctttgtacttag

SEQ ID NO: 22025 - DNA, 356 bp, Artificial
  Mutation in BnaC.FAD2.a introduced by TALE nuclease pair BnFAD2_T02
cctctcctccctcaccctctctcctacttcgcctggcctctctcctgggcctgccagggatgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcagtcccggctggcctctgtgcttag

SEQ ID NO: 22026 - DNA, 355 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcacgctcggctggcctttgtacttag

SEQ ID NO: 22027 - DNA, 336 bp, Artificial
  Mutation in BnaC.FAD2.a introduced by TALE nuclease pair BnFAD2_T02
cctctcctccctcaccctctaacctacttcgcctggcctctctaatgggcctgccaagggtgcgtcccaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcgagtacctcaacaaccctctgggtcgccccgtgaggttaacggcgcatgtcactcgcggctgccctttgtacttag

SEQ ID NO: 22028 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcctcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22029 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 22030 - DNA, 397 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatgcccgaggaatagactgtaccccaaaaaaacagtcataagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22031 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttatcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22032 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacacgttgggaagcaccgtgatgttaacggttcagttcacgctcggctggcctttgtacttag

SEQ ID NO: 22033 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaggcagacatcaagtggtacggcaagtacctcaacaaccctttgggacgcaccgtgatgttaacggttcagttcactctcggctggcatttatacttag

SEQ ID NO: 22034 - DNA, 347 bp, Artificial
  Mutation in BnaC.FAD2.a introduced by TALE nuclease pair BnFAD2_T02
cctctcctccctcaccctctctcctacttcgcctggcatctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacctctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 22035 - DNA, 310 bp, Artificial
  Mutation in BnaC.FAD2.a introduced by TALE nuclease pair BnFAD2_T02
cctctcctccctcaccctctctcctactccgcctggccaccttactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctgtggtacgcaccgggatgttaacggttcagttcactctcggctggcctttgtacttag

SEQ ID NO: 22036 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 22037 - DNA, 455 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtatcatcttccactccttcctcctcgtcccttacttctcctgacggtccagcgcctgcttgccggtgctgtgccaggcccacggcttgaccccccagcaggtggtggccatcgccagcaatggcggtggcaagcaggcgctggagtcatcgacgccaccattccaacactggctccctcgagagagacgaagtgttggtccccaagaagaagtcagacatcaagtggtacggcaagtacctcaacaaccctttgggacgcaccgtgatgttaacggttcagttcacgctcggctggcctttgtacttag

SEQ ID NO: 22038 - DNA, 344 bp, Artificial
  Mutation in BnaC.FAD2.a introduced by TALE nuclease pair BnFAD2_T02
cctctcctccctcaccctctctcctacttcgcctggccactctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgtggtacttag

SEQ ID NO: 22039 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtagtcatcgacgccaccattccaacactcgccccctcgagagagacgaagtgtttgtccccaagaagaagtcagacctcaagtggtacggcaagtaccccaacatcccttcgggacgcaccgtgatgttaacggctcagttgactctcggctggcctttgtacttag

SEQ ID NO: 22040 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttcctccattccaacactggctccctcgagagagacgaagtgtttgtccccaagaagaagtcacacatcaagtggtacggcaagtacctcaacaacccttcgggacgcaccgtgatgttaaccgttcaattcacgctcgcctggccttagtacttag

SEQ ID NO: 22041 - DNA, 400 bp, Artificial
  Mutation in BnaC.FAD2.a introduced by TALE nuclease pair BnFAD2_T02
cctctcctccctcaccctctctcctacttcgcctggcctctctactgggcctgcaaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccaggcccacggcttgaccccggagcaggtggtggtcatcgcctggcacagcaccggcaacagccgctggaccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22042 - DNA, 356 bp, Artificial
  Mutation in BnaC.FAD2.a introduced by TALE nuclease pair BnFAD2_T02
cctctcctccctcaccctctctcctacttcgccttgcctctctactgggcctgccacggctgcgtcctaacgggcctctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgaccccaagaagaagtcagacatcaagtggtacggcaagtacctcaacaaccctttgggacgcaccgtgatgttaacgtttcagtgcactctcggctggcctttgtactta

SEQ ID NO: 22043 - DNA, 357 bp, Artificial
  Mutation in BnaC.FAD2.a introduced by TALE nuclease pair BnFAD2_T02
cctctactccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22044 - DNA, 335 bp, Artificial
  Mutation in BnaC.FAD2.a introduced by TALE nuclease pair BnFAD2_T02
cctctcctccctcaccctctctcctacttcgcctggcctatctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22045 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacctgcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggcgggcctttgtacttag

SEQ ID NO: 22046 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggttggccttggtacttag

SEQ ID NO: 22047 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggatttgtcctactcaggagagcgttcaccgacaaacaacagataaaacgaaaggccgtcagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22048 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcacggtgaggctaaccgtccagttcacgcttggctggccttagtacttag

SEQ ID NO: 22049 - DNA, 330 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 22050 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagtccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22051 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22052 - DNA, 330 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcgccaccattccaacactggctccctcgagagagacgaagtgtttgtccccaagaagaagtcagacatcaagtggtacggcaagtacctcaacaaccctgtgggacgcaccgtgatgttaacgtttcagttcactctcggctggcctgtgtacttag

SEQ ID NO: 22053 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 22054 - DNA, 357 bp, Artificial
  Mutation in BnaC.FAD2.a introduced by TALE nuclease pair BnFAD2_T02
cctctcctccctcaccctctcccttacctcgcctgtcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22055 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 22056 - DNA, 303 bp, Artificial
  Mutation in BnaC.FAD2.a introduced by TALE nuclease pair BnFAD2_T02
cctctcctccctcaccctctctcctacttcgcctggcctccctcctgggcctgccaagggtgcgtcctaaccggcgtctgggtcatagcccacgagtgcggccaccacgccttcagcgactaccagtggcttgacgacaccgtcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctgtgtacttag

SEQ ID NO: 22057 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaaatccgacatcaagtggtacggaaagtacctcaacaacccgctaggacgcgcggtgaggctaaccggccaggtgtcgcctggcgggcctttgtacttag

SEQ ID NO: 22058 - DNA, 358 bp, Artificial
  Mutation in BnaC.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggccggcctttgtacttag

SEQ ID NO: 22059 - DNA, 356 bp, Artificial
  Mutation in BnaC.FAD2.a introduced by TALE nuclease pair BnFAD2_T02
cctctcctccctcaccctctctcctacttcgcctggccactctactgggcctgccaagggcgcgccctaaccggcgtctgggtcatagcccacgagtgcggccaccacgccttcagcgactaccagtggcttgacgacaccgtcggcctcatcttccactccttcctcctcgtcccttacttctcctggaactcatcgacgccaccattccaacactggctccctcgagagagacgaagtgtttgtccccaagaagaagtcagacatcaactggtacggcaagtacctcaacaaccctttgggacgcaccgtgaggttaacggttcagttccctctcggctggcctttgtacttag

SEQ ID NO: 22060 - DNA, 359 bp, Artificial
  Mutation in BnaC.FAD2.a introduced by TALE nuclease pair BnFAD2_T02
cctctcctccctcaccctctcccttacctcgcctggcccctctcctgggcctgccaagggtgcgtcctcaccggcgtctgggtcatagcccacgagtgcggccaccacgccttcagcgactaccagtggcttgacgacaccgtcgggctcatcttccactccttccccctcgtcccttacttctcctggaaacagtcatcgacgccaccattccaacactggctccctcgagagagacgaagtgttcgtccccaagaagaagtcagacatcaagtggtacggcaagtacctcaacaaccctgtgggacgcaccgtgaggttaacggtacaggtcactctcggctggcctttgtacttag

SEQ ID NO: 22061 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 22062 - DNA, 357 bp, Artificial
  Mutation in BnaC.FAD2.a introduced by TALE nuclease pair BnFAD2_T02
cctctcctccctcaccttctctcctacttcgcctggcctctctactgggcctgccaagggtgcgtcctaaccggcgtctgggtcatagcccacgagtgcggccaccacgccttcagcgactacaagtggcttgacgacaccgtcggtctcatcttccactccttcctcctcgtcccttacttctcctggaaagtcatcgaagccaccattccaacactggctccctcgagagagacgaagtgtttgtccccaagaagaagtcagacatcaagtggtacgtcaagtacctcaacatccctttgggacgcaccttgatgttaaccgttcagttccctctcggctggcctttgtacttag

SEQ ID NO: 22063 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22064 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaacagtcatcgacgccaccattccaacactggctccctcgagagagacgaagtgtttgtccccaagaagaagtcagacatcaagtggtacggaaagtacctcaacaaccctttgggacgcaccgtgatgttaacggttcagttcactctcggctggcctgtgtacttag

SEQ ID NO: 22065 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22066 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggttcggcaagtacctcaacaaccctttgggacgcaccgtgatgttaacggttcagttcactctcggctggcctttgtacttag

SEQ ID NO: 22067 - DNA, 379 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggctccgcccccctgacgagcatcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggccttagtacttag

SEQ ID NO: 22068 - DNA, 345 bp, Artificial
  Mutation in BnaC.FAD2.a introduced by TALE nuclease pair BnFAD2_T02
cctctcctccctcacccgctgtcctacttcgcctggcctctctcctgggcctgccaagggtgcgtcctaacaggcgtctgggtaatagcccacgagtgcggccaccacgacttcagcgactaccagtggcttgacgacaccgtcggtctcatcttccactccttcctcctcgtcccttacttcatcgacgccaccattccaacactggctccctcgagagagactaagtgtttgtccccaagaagaagtcagacatcaagtggtacggcaatgacctcaacaaccctttgggacgcaccgtgaggttaacgtttcatttcactcgcgcctggcctgtgtacttag

SEQ ID NO: 22069 - DNA, 357 bp, Artificial
  Mutation in BnaC.FAD2.a introduced by TALE nuclease pair BnFAD2_T02
cctctcctccctcaccctctctcctacttcgcctggcatttttcctgggcctgccaagggtgcgtcctaaccggcgtctgggtcatagcccacgagtgcggccaccacgccttcagcgactaccagtggcttgacgacaccgtcggtctcatcttccactccttcctcctcatcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggccggcctgtgtacttag

SEQ ID NO: 22070 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactactagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22071 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtaccttaacaaccctttgggacgcaccgtgatgttaacggttcagttcactctcggctggcctttgtacttag

SEQ ID NO: 22072 - DNA, 356 bp, Artificial
  Mutation in BnaC.FAD2.a introduced by TALE nuclease pair BnFAD2_T02
cctctcctccctcaccctctctcctacttcgcctcgcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22073 - DNA, 359 bp, Artificial
  Mutation in BnaC.FAD2.a introduced by TALE nuclease pair BnFAD2_T02
gctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 22074 - DNA, 357 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgaggctaaccgtccagttcacgtgcggctggcctgtgtacttag

SEQ ID NO: 22075 - DNA, 336 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 22076 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgggattag

SEQ ID NO: 22077 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22078 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacaccggatccctcgagagggatgaagtgttcgtccccaagaagaaatccgccatcaagtggtacggaaagtacctcaacaacccgctagaacgcacggtgatgctaaccttccatttcacgctcggctggcctttgtacttag

SEQ ID NO: 22079 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaaccgtccagttcacgctcggctggcctttgtacttag

SEQ ID NO: 22080 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgcattcagcgactaccagtggcttgacgacaccgtcggtctcatcttccactccttcctcctcgtcccttacttctcctggaagttatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22081 - DNA, 357 bp, Artificial
  Mutation in BnaC.FAD2.a introduced by TALE nuclease pair BnFAD2_T02
cctctcctccctcaccctctctcctacttcgcctggcctccctactgggcctgccaagggtgcgtcctaaccggcatctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 22082 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcacggtgatgctaaccggccagttcacgctcggctggcctgtgtacttag

SEQ ID NO: 22083 - DNA, 312 bp, Artificial
  Mutation in BnaC.FAD2.a introduced by TALE nuclease pair BnFAD2_T02
cctctcctccctcaccatctctcctacttcgcctggcatctctactgggcctgccaagggtgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 22084 - DNA, 355 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22085 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctgtgtacttag

SEQ ID NO: 22086 - DNA, 310 bp, Artificial
  Mutation in BnaC.FAD2.a introduced by TALE nuclease pair BnFAD2_T02
cctctcctccctcaccctctcacttacctcgcctggcccctctactgggcctgccaagggtgcgtcctaacgggcctctgggtcatcgcacacgaatgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctgtgtacttag

SEQ ID NO: 22087 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 22088 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22089 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22090 - DNA, 357 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgaggttaacgggtcagttcactctcggctggcctttgtacttag

SEQ ID NO: 22091 - DNA, 361 bp, Artificial
  Mutation in BnaC.FAD2.a introduced by TALE nuclease pair BnFAD2_T02
cctctcctccctcaccctctctcctacttcgcctggcctctctactgggcctgccaaggtgcgtcctaaccggcgtctgggtcatagcccacgagtgcggccaccacgccttcagcgactaccagtggctggacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 22092 - DNA, 356 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaaggacctcaacaaccctttgggacgcaccgggatgttaacggttcaggtcactcgcggctggcctgtgtacttag

SEQ ID NO: 22093 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctgtgggacgcaccgtgatgttaacggtgcagttcactctcggctggcctttgtacttag

SEQ ID NO: 22094 - DNA, 356 bp, Artificial
  Mutation in BnaC.FAD2.a introduced by TALE nuclease pair BnFAD2_T02
cctctcctccctcaccctctctcctacttcgcctggcctctctactgggcctaccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22095 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctgtgtacttag

SEQ ID NO: 22096 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactcgcggctggcctgtgtacttag

SEQ ID NO: 22097 - DNA, 358 bp, Artificial
  Mutation in BnaC.FAD2.a introduced by TALE nuclease pair BnFAD2_T02
cctctcctccctcaccctctttcctacttcgcctggcctctctctcgggcctgccaagggtgcgtcctcaccggcgtctgggtcatagcccacgagtgcggccaccacgccttcagcgactaccagtggcttcacgacaccgtctgtctcctcttccactccttcctcctcgtcccttacttctcctggaagtatcatcgacgccaccattccaactctggctccctcgcgagagacgaagtgtttgtccccaataagaagtcagacatcaagtggtacggcaagtacctcaacaaccctttgggacgcaccgtgatgtttacgtttcaggtcactctcggccgccctatgtgcttag

SEQ ID NO: 22098 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 22099 - DNA, 361 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactgtcggctggccgttgtacttg

SEQ ID NO: 22100 - DNA, 350 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 22101 - DNA, 359 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgatgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22102 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcacacatcaagtggtacggcaagtaccccaacgtgccttcggaacgcaccgtgaggttaacggttcagttcactccaggccggccttagtgcttag

SEQ ID NO: 22103 - DNA, 331 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaaatccgacatcaagtggtacggaaagtacctcaacaaccctgctggacgcaccgggatggtaacggttcagttcactctcggcgggcctttgtacttag

SEQ ID NO: 22104 - DNA, 356 bp, Artificial
  Mutation in BnaC.FAD2.a introduced by TALE nuclease pair BnFAD2_T02
cctctcctccctcaccctctcacttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccgagaagaaatccgacatcaagtggtacggaaagtacctcaacaacccgctagaacgcacggtgatgctaaccgtccagttcacgctcggctggcctgtgtacttag

SEQ ID NO: 22105 - DNA, 355 bp, Artificial
  Mutation in BnaC.FAD2.a introduced by TALE nuclease pair BnFAD2_T02
cctctcctccctcccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22106 - DNA, 353 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22107 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 22108 - DNA, 322 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccgtcctccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22109 - DNA, 366 bp, Artificial
  Mutation in BnaC.FAD2.a introduced by TALE nuclease pair BnFAD2_T02
ccctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22110 - DNA, 356 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 22111 - DNA, 360 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22112 - DNA, 396 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctccccgtcccttacttctccccacggcttgaccccccagcaggtgttggccctcgccattctccactcatcgacgccaccattccaacaccggatccctcgagagggatgaagtgttcgtccccaagaagaaatccgacatcaagtggtacggaaagtacctcaacaacccgctaggacgcacggtggggctaaccgtccagttcacgctcggctggcctttgtacttag

SEQ ID NO: 22113 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcctcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22114 - DNA, 352 bp, Artificial
  Mutation in BnaC.FAD2.a introduced by TALE nuclease pair BnFAD2_T02
cctcacctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22115 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcgagtacctcaacaaccctttgggacgcaccgtgatgttaacggttcagttcactctcggctggcctgtgtacttag

SEQ ID NO: 22116 - DNA, 330 bp, Artificial
  Mutation in BnaC.FAD2.a introduced by TALE nuclease pair BnFAD2_T02
cctctcctccctcaccctctatcctacttcgcctggcatatctactgggcctgccaagggtgcgtcctaaccggcgtctgggtcatagcccacgagtgcggccaccacgccttcagcgactaccagtggcttgacgacaccgtcggtctcatcttccactccttcctcctcgtcgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 22117 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttttcctggaaagtcatcgacgccaccattccaacactggctccctcgagagagacgaagtgtttgtccccaagaagaagtcagacatcaagtggtacggaaagtacctcaacaacccgctaggacgcaaggtgatgctaaccgtccagttcacgctcggctggcctttgtacttag

SEQ ID NO: 22118 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 22119 - DNA, 356 bp, Artificial
  Mutation in BnaC.FAD2.a introduced by TALE nuclease pair BnFAD2_T02
cctctcctccctcactctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 22120 - DNA, 352 bp, Artificial
  Mutation in BnaC.FAD2.a introduced by TALE nuclease pair BnFAD2_T02
cctctcctccctcaccctctcccctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaacccttagggacgcaccgtgaggttaacggttcaggtcactctcggctgtcctttgtacttag

SEQ ID NO: 22121 - DNA, 395 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccgccggagtaggccttggtgtccacgatcacgccgtagtcatcgacgccaccattccaacactggctccctctagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22122 - DNA, 355 bp, Artificial
  Mutation in BnaC.FAD2.a introduced by TALE nuclease pair BnFAD2_T02
cctctcctccctcaccctctctcctacttcgcctggcatctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctgtgtacttag

SEQ ID NO: 22123 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggttcggcaagtacctcaacaaccctttgggacgccccgtgatgttaacggttcagttcactctcggctggccttagtacttag

SEQ ID NO: 22124 - DNA, 356 bp, Artificial
  Mutation in BnaC.FAD2.a introduced by TALE nuclease pair BnFAD2_T02
cctctcctccctcaccctctcccttacctcgcctggcccatctaatgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctctagagagacgaagtgtttgtccccaagaagaagtcagacatcaagtggtacggcaattacctcaacaaccctttgggacgcaccgtgatgttaacggttcagttcactcgcggctggcctgtgtacttag

SEQ ID NO: 22125 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttcggacgcaccgtgatgttaacggttcagttcactctcggctggcctttgtacttag

SEQ ID NO: 22126 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccacgggtgcgtcctaaccggcgtctgggtcatcgcccacgagtgcggccaccacgccttcagcgactaccagtggctttacgacaccgtcggtctcatcttccactccttcctcctcctcccttacttctcctggaccagcgacgccaccattccaacactggctccctcgagagagacgaagtgtttgtccccaagaagaaggcagacatcaagtggtccggcaagtacctcaacaaccctttgggacgcgccgtgatgttaacggttcaggtcattctcggctggcctttgtacttag

SEQ ID NO: 22127 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 22128 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggccggcctttgtacttag

SEQ ID NO: 22129 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacgttgcaggtcactcgcggcaggcctgtgtacgtag

SEQ ID NO: 22130 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 22131 - DNA, 312 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22132 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacgtttcatttcactcgcgcccggcctgtgtacttag

SEQ ID NO: 22133 - DNA, 331 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22134 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgacccccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22135 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaggcgctaaatgaaaccttaacgctatggaacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22136 - DNA, 409 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagcaacagccgctggaccgtctccagcgcctgcttgccgccatcgtggctggcgagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22137 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatagacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctgtgtacttag

SEQ ID NO: 22138 - DNA, 356 bp, Artificial
  Mutation in BnaC.FAD2.a introduced by TALE nuclease pair BnFAD2_T02
cctctcctccctcaccctctctcctacttcgcctggcctatctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22139 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22140 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgagtctaaccgtccaggtcacgcgcggctggcctgagtacttag

SEQ ID NO: 22141 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22142 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggcaggcctttgtacttag

SEQ ID NO: 22143 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22144 - DNA, 405 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtactccagcggctgttgccaccattattgctggcgatggccaccacctgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 22145 - DNA, 312 bp, Artificial
  Mutation in BnaC.FAD2.a introduced by TALE nuclease pair BnFAD2_T02
cctctcctccctcaccctctctcctacttcgcctggcctacctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaaggacctcaacaaccctttgggacgcaccgggatgttaacggttcaggtcactcgcggctggcctttgtacttag

SEQ ID NO: 22146 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacgccaagtacctcaacaacccgttgggacgcaccgtgaggttaacggttcagttcactcgcggccggcatttgtacttag

SEQ ID NO: 22147 - DNA, 327 bp, Artificial
  Mutation in BnaC.FAD2.a introduced by TALE nuclease pair BnFAD2_T02
cctctcctccctcaccctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22148 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22149 - DNA, 356 bp, Artificial
  Mutation in BnaC.FAD2.a introduced by TALE nuclease pair BnFAD2_T02
cctctcctccctcaccctctctcctacttcgcctggcctatctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctttgggacgcgccgtgatgttaacggttcagttcactctcggcgggcctttgtacttag

SEQ ID NO: 22150 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacactgtcggtctcatcttccactccttcctcctcgtcccttacttctcctggaagagtcatcgacgccaccattccaacactggctccctcgagagagacgaagtgtttgtccccaagaagaaatccgacatcaagtggtacggaaattacctcaacaacccgctaggacgcacggtgaggctaaccgtccagttctcgctcggccggcctttgtacttag

SEQ ID NO: 22151 - DNA, 355 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctgtgtacttag

SEQ ID NO: 22152 - DNA, 351 bp, Artificial
  Mutation in BnaC.FAD2.a introduced by TALE nuclease pair BnFAD2_T02
cctctcctccctcaccctctctcctacttcgcctggcctcactactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaatactggctccctcgagagagacgaagtgtttgtccccaagaagaagtcagacatcaagtggtacggcaagtacctcaacaaccctgtgggacgcaccgggaggttaacggtgcaggtcactcgcggcgggccttggtacttag

SEQ ID NO: 22153 - DNA, 344 bp, Artificial
  Mutation in BnaC.FAD2.a introduced by TALE nuclease pair BnFAD2_T02
cctctcctccctcaccctctcccttacctcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 22154 - DNA, 441 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagctcggtttgatcgacagtggcgcagcaccacgaggcactggtcggccacgggtttacacacgcgcacatcgttgcgttaagccagtcatcgacgccaccagtccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22155 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 22156 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22157 - DNA, 353 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaatggttcagttcactctcggctggcctttgtacttag

SEQ ID NO: 22158 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 22159 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttaatcgtgtcatcgacgccaccattccaacgctggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22160 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22161 - DNA, 357 bp, Artificial
  Mutation in BnaC.FAD2.a introduced by TALE nuclease pair BnFAD2_T02
cctctcctccctcaccctctcacttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22162 - DNA, 365 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaacagtcatcgacgccaccattccaacactggctccctcgagagagacgaagtgtttgtccccaagaagaagtcagacatcaagtggtacggcaaggacctcaacaaccctttgggacgcaccgtgatgttaacggttcagttcactctcggccggcctgtgtacttag

SEQ ID NO: 22163 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22164 - DNA, 357 bp, Artificial
  Mutation in BnaC.FAD2.a introduced by TALE nuclease pair BnFAD2_T02
cctctcctccctcaccctctcccctacttcgcctggcctctctactgggcctgccaagggtgcgtcctaaccggcgtctgggtcatagcccacgagtgcggccaccacgccttcagcgactaccagtggcttgacgacacagtcggtctcatcttccactccttcctcctcgtcccttacaacggcgagctttgaacaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22165 - DNA, 357 bp, Artificial
  Mutation in BnaC.FAD2.a introduced by TALE nuclease pair BnFAD2_T02
cctctcctccctcaccctctcacttacctcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 22166 - DNA, 291 bp, Artificial
  Mutation in BnaC.FAD2.a introduced by TALE nuclease pair BnFAD2_T02
cctctcttccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22167 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22168 - DNA, 362 bp, Artificial
  Mutation in BnaC.FAD2.a introduced by TALE nuclease pair BnFAD2_T02
ctctcctccctcaccctatcccttacctcgcctggcctctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22169 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtcttag

SEQ ID NO: 22170 - DNA, 359 bp, Artificial
  Mutation in BnaC.FAD2.a introduced by TALE nuclease pair BnFAD2_T02
cctctcctccctcaccctctcccttacctcgcctggaccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22171 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggccttggtacttag

SEQ ID NO: 22172 - DNA, 355 bp, Artificial
  Mutation in BnaC.FAD2.a introduced by TALE nuclease pair BnFAD2_T02
cctctcctccctcaccctctcacttacctcgcctggaccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 22173 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccagatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22174 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22175 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22176 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22177 - DNA, 471 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccagcaataatggtggcaagcaggcgctggagacgatccagcggctgttgccggtgccgtcccaggcccacggcttgaccccccagcaggtggtggccatcgccagcaatacagccagcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22178 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22179 - DNA, 324 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgcccagttcacgctcggctggcctttgtacttag

SEQ ID NO: 22180 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22181 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22182 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22183 - DNA, 419 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacattccgtggcgttatccagctaagcgcgaactgcaatttggagaatggcagcgcaatgacacatcgacgccaccattccaacaccgaatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22184 - DNA, 274 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22185 - DNA, 359 bp, Artificial
  Mutation in BnaC.FAD2.b introduced by TALE nuclease pair BnFAD2_T02
cctctcctccctcaccctctctcctacctcgcctggcccctctactgggcctgccaaggctgcgtcctgacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22186 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22187 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaagacgcacagtgatgctaaccgtccagttcacgctcggctggcctttgtacttag

SEQ ID NO: 22188 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22189 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22190 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22191 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22192 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22193 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22194 - DNA, 343 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22195 - DNA, 357 bp, Artificial
  Mutation in BnaC.FAD2.b introduced by TALE nuclease pair BnFAD2_T02
cctctcctccctcaccctctcccttacctagcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22196 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22197 - DNA, 401 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtactgcccgctttccagtcgggaaacctgtcgtgccagctgcaagccatcgacgccaccattccaacaccggatccctcgagagggatgaagtgttcgtccccaagaagaaatccgacatcaagtggtacggaaagtacctcaacaaccagctaggacgcacggtgatgctaaccgtccagttcacgctcggctggcctttgtacttag

SEQ ID NO: 22198 - DNA, 336 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacaggcgtctgggtcatagcccacgagtgcggccaccacgccttcagcgactaccagtggcttgacgacaccgtcggtctcatcttccactccttcctcctcgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22199 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22200 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 22201 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22202 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22203 - DNA, 355 bp, Artificial
  Mutation in BnaC.FAD2.b introduced by TALE nuclease pair BnFAD2_T02
ccttcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22204 - DNA, 357 bp, Artificial
  Mutation in BnaC.FAD2.b introduced by TALE nuclease pair BnFAD2_T02
cctctcctccctcaccctctctcctacctcgcctggcccctctactgggcctgccaaagctgcgtcctaacgggcctctgggtcatcgcccacgaatgcggccaccacgccttcagcgaccaccagtggctggacgacgccgtgggcatcatcttccactccttcctcctcgtcccttacttctcctggaaagtcatcgacgccaccattccaacactggctccctcgagagagacgaagtgtttgtccccaagaagaaacccgacatcaagtggtacggaaagtacctcaacgtccggctaggacgaccggtggtgctaaccgcacaggtcacgctcgcccgccctcagcacttac

SEQ ID NO: 22205 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22206 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22207 - DNA, 367 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtacacacacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22208 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22209 - DNA, 391 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatacctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22210 - DNA, 352 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcctctgggtcatcgcccacgaatgcggccaccacgccttcagcgaccaccagtggctgtacgacgccgtgggcctcgtcttcccctccttcctcctcgtcccttacttctcctggactcgacgccacccttccaacaccggatccctcgcgagggatgaagtgttcgtccccaagaagaaatccaacatcaagtggtacggaaagtacatcaacaacccgctagaacgcacggtgatgctaacggtccagttcacgcgcggctggccttagtacgtag

SEQ ID NO: 22211 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22212 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22213 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22214 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagggcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22215 - DNA, 342 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22216 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22217 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22218 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22219 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgtttgtccccaagaagaagtcagacatcaagtggtacggcaagtacctcaacaacccttttggccgcaccgtgatgttaacggttcggttcactctcggctggcctttgtacttag

SEQ ID NO: 22220 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22221 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22222 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22223 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22224 - DNA, 274 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22225 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22226 - DNA, 326 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22227 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22228 - DNA, 355 bp, Artificial
  Mutation in BnaC.FAD2.b introduced by TALE nuclease pair BnFAD2_T02
cctctcctccctcaccctctctcctacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggagtcatcgacgccaccattccaacactggctccctcgagagagaagaagtgttcgtccccaagaagaaatccgacatcaagtggtacggaaagtacctcaacaacccgctaggacgcacggtgatgctaaccgttcagttcacgctcggctggcctttgtacttag

SEQ ID NO: 22229 - DNA, 472 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatgtccaagataagcctgtctagcttcaagtatgacgggctgacggcgtgatcgtggacaccaaggcctactccggcggctaggcgacgaggtggtcgttggtcaacgcggccagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22230 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacgtag

SEQ ID NO: 22231 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22232 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22233 - DNA, 358 bp, Artificial
  Mutation in BnaC.FAD2.b introduced by TALE nuclease pair BnFAD2_T02
cctctcctccctccccctctcccttccctcgcctggcccctctactgggcctgccaaggctgcgtcctaacgggcctctgggtcatcgcccacgaatgcggccaccccgccttcagcgaccaccagtgcctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcgcctagcctttgtacttag

SEQ ID NO: 22234 - DNA, 359 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22235 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctttgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22236 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22237 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 22238 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22239 - DNA, 411 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtggcaagcaggcgctggagacggtccagcggctgttgccggtgctgtgccaggcccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22240 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22241 - DNA, 384 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacgccgaggcgacacacgaagcgatcgttggcgtcggcaaacacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22242 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22243 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22244 - DNA, 444 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatcttcgagccagccacgatcgacattgatctggctatcttgctgacaaaggcgctggagacggtccagcggctgttgccggtgctgtcatcgacgccaccatttcaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22245 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22246 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22247 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22248 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22249 - DNA, 474 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagcaggtggtggccatcgccagcaatggcggtggcaagcaggcgcgggaccgtctccagcgcctggtgccggtgctgtgccaggcccacggcttgaccccccagcaggtggtggccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22250 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22251 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22252 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggatacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22253 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22254 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22255 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22256 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22257 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22258 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccaagggcgcgtcctaaccggcgtctgggtcatcgcccacgaatgcggccaccacgccttcagcgaccaccagtggctggacgacgccgtgggcctcgtcctccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacgtag

SEQ ID NO: 22259 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaaagccatcgacgccaccattccaacaccggatacctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22260 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22261 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22262 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22263 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacagcccgcgaggacacacggtgatgctagccgtccagttcacgctcggctggcctttgtactcag

SEQ ID NO: 22264 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgttcgtccccaagaagaaatccgacatcaagtggtaccgaaagtacctcaacaacccgctaagacgcacggtgatgctaaccgtccagttcacgctccgctggcctttgtccttag

SEQ ID NO: 22265 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatcccccgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22266 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22267 - DNA, 291 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22268 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22269 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22270 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22271 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22272 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22273 - DNA, 356 bp, Artificial
  Mutation in BnaC.FAD2.b introduced by TALE nuclease pair BnFAD2_T02
cctctcctccctcaccctctcccttacctcttctggctcctctactgggcctcccaagtctgcgccctcacggccctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtagctcaacaagccgctaggacgcacggtgatgctaaccctccagttcacgctcggctggcctttgtacttag

SEQ ID NO: 22274 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22275 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccatcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22276 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22277 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22278 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22279 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22280 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttaattctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22281 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22282 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaacgggcgtctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaaccctctaggacgcaccgtgatgctaaccgtccagttcacgctcggctggcctttgtacttag

SEQ ID NO: 22283 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctcttggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaacaaacccgacatcacgtcgtacggaaactacctcaacaaccctctaggccgcccggtgaggctacccgtccggttcccgcccggatggcctttgtacttag

SEQ ID NO: 22284 - DNA, 332 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22285 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctccttcgacgccaccattccaacactggctccctcgagagggatgaagtgttcgtccccaagaagaaatccgacatcaagtggtacggaaagtacctcaacaaccagctaggacgcacggtgatgctaaccgtccagttcacgctcggctggcctttgtacttag

SEQ ID NO: 22286 - DNA, 389 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcggacttcctggagccgcccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22287 - DNA, 394 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22288 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22289 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22290 - DNA, 406 bp, Artificial
  Mutation in BnaC.FAD2.b introduced by TALE nuclease pair BnFAD2_T02
cctctccccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtacggtgctgttccgggcgatctcgatcagctcgatgtactcgtgggacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22291 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22292 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggggatgctaaccgtccagtgcacgcgcggctggcctgtgtacttag

SEQ ID NO: 22293 - DNA, 350 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactcctttctcctcgtcccttactcctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22294 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagacaccatcgacgccaccattccaacaccgggtccctcgagagggatgaagtgttcgtccccaagaagaaatcccacatcgagtggtacggaaagtacctcaacaccccgctagaacgcacggtgatgctaaccgtccagttcacgctcggctgccctttgtacttag

SEQ ID NO: 22295 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22296 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22297 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgtggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22298 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22299 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22300 - DNA, 359 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcctacgaatgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22301 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctagaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22302 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaaaacccgctaggacgcacggtgatgctaaccgtccagttcacgctcggctggcctttgtacttag

SEQ ID NO: 22303 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22304 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacggacggtgatgctaaccggacgggtcaggctcggctggcctttgtacttag

SEQ ID NO: 22305 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcgtcttccactccttcctcctcgtcccttacttctcctggaaggccatcgacgccaccattccagcaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22306 - DNA, 348 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtacttag

SEQ ID NO: 22307 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctactcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22308 - DNA, 365 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcctcctcgtcccttacttctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22309 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22310 - DNA, 324 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22311 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccgtcgggagggatgaagtgttcgtccccaagaagaaatccgacatcaagtggtacgagaagtacctcaacaacccggtgggaagcaccggaatgttaacggttaagttcactctcggctggcctttgtacgtag

SEQ ID NO: 22312 - DNA, 355 bp, Artificial
  Mutation in BnaC.FAD2.b introduced by TALE nuclease pair BnFAD2_T02
cctctcctccctcaccctctcccttaactcgcctggcccctctactgggcctgctaaggctgcgtcctaacgtgcctctgggtcatcgccctcgaatgcggccaccacgccttcagcgacctccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggaaagtacatcaacaacccgctaggacgcaccgtgatggtaaccgtccagttcactcccggctggcagttatacttgg

SEQ ID NO: 22313 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgacccccagtggctggacgaccccgtgggcctcgtcttccactccttcctcctcgtcccttacttctcctggaatcgacgccaccattccaacaccggatccctcgagagggatgaagtgttcgtccccaagaagaagtcaaacatcaagtggtacggcaagtacctcaacaaccctttggagcgcaccgtgatgttaacggttcagttcactctcggctggcctttgtacttag

SEQ ID NO: 22314 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22315 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22316 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22317 - DNA, 324 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22318 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22319 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22320 - DNA, 365 bp, Artificial
  Mutation in BnaC.FAD2.b introduced by TALE nuclease pair BnFAD2_T02
cctctcctccctcaccctctcccttacctcgcctgacccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22321 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgcctccagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22322 - DNA, 363 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcacgtggtacggaaagtaccccaacaaccctttgggacgcaccgtgagtttaacggtgcagttctctctcggctggcttttgtccctag

SEQ ID NO: 22323 - DNA, 470 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtgatcatctcgccgccgatcaggagctcctccacggacagcacggcgccgtgccaggcccacggcttgaccccccagcaggtggtggccatcgccagcaataatggtggcacagccatcgacgccaccattccaacaccggatccctcgagagggatgaagtgttcgtccccaagaagaaatccgacatcaagtggtacggaaagtacctcaacaaccagctaggacgcacggtgatgctaaccgtccagttcacgctcggctggcctttgtacttag

SEQ ID NO: 22324 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatctacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22325 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22326 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22327 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcacctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22328 - DNA, 357 bp, Artificial
  Mutation in BnaC.FAD2.b introduced by TALE nuclease pair BnFAD2_T02
cctctcctccctaaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctacgacgcacggtgatgctaaccgtccagttcacgctcggctggcctttgtacttcg

SEQ ID NO: 22329 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtcggggtcatagcccacgagtgcggccaccacgccttcagcgaccaccagtggctggacgacgccgtgcgcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcagcaacccgctaggacgcacggtgatgctaaccgtccagttcactctcggctggcctttgtacttag

SEQ ID NO: 22330 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 22331 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttagc

SEQ ID NO: 22332 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcgtcttccactccttcctcctcgtcccttacttctcctggaatcgacgccaccattccaacaccggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22333 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggccccgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22334 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgagcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagagacgaagtgtttgtccccaagaagaaatccgacatcaagtggtacggaaagtacctcaacaacccgctgggacgcacggtgatgctaaccgtccagttcacgctcggctggcctttgtacttag

SEQ ID NO: 22335 - DNA, 389 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccaaccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 22336 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggttatgctaaccgtccagttcacgctcggctggcctttgtacttag

SEQ ID NO: 22337 - DNA, 354 bp, Artificial
  Mutation in BnaC.FAD2.b introduced by TALE nuclease pair BnFAD2_T02
cctctcctccctcaccctctctcctacttcgcctggcctctccactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 22338 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagccatcgacgccaccattccaacaccggatccctcgagagggatgaagtgttcgtccccaagaagaaatccgacatcaagtggtacggaaagtacctcagcaacccgcgaggacgcacggtgatgctaaccgtccagttcacgctcggctggcctttgtacttag

SEQ ID NO: 22339 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22340 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacagcaagtggtacggaaagtacctcaacaacccgctagaacgcgcggtgatgttaaccgtccagttcacgctcggctggcctttatacttag

SEQ ID NO: 22341 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22342 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcgacgccaccattccaacaccggatccctcgagagggatgaagtgttcgtccccaagaagaaagccgacatcaagtggtacggaaagtacctcaacaacccgctaggacgcacggtgatgctaaccgtccagttcacgctcggctggcctttgtacttag

SEQ ID NO: 22343 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacacagccatcgacgccaccattccaacaccggatccctcgagagggatgaagtgttcgtccccaagaagaaatccgacatcaagtggtacggaaagtacctcaacaacccgctaggacgctcggtgatgctaaccgtccagttcacgctcggctggcctttgtacttag

SEQ ID NO: 22344 - DNA, 358 bp, Artificial
  Mutation in BnaC.FAD2.b introduced by TALE nuclease pair BnFAD2_T02
cctctcctccctcaccctctcccttacctcgcatggcccctctactgggcctgccaagggtgcgtcctaacgggcctctgggtcatcgcccacgaatgcggccaccacgccttcagcgaccaccagtggctggacgccgccgtgggcctcgtcttccactccttcctcctcgtcccttacttctcctggaagtatcatcgacgccaccattccaacaccggatccctcgagagggatgaagtgttcgtccccaagaagaaatccgacatcaagtggtacggaaagtacctcagcaacccgcgaggacgcacggtgatgctaaccgtccagttcacgctcggctggcctttgtacttag

SEQ ID NO: 22345 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaaggagaaatccgacatcaagtggtacggaaagtacctcaacaacccgctaggacgcacggtgatgctaaccgtccagttcacgctcggctggcctttgtacttag

SEQ ID NO: 22346 - DNA, 356 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgaatgcggccaccacgccttcagcgaccaccagtggctggacgacgccgtgggcctcgtcttcccctccttcctcctcgtcccttacttctcctggaagccatcgacgccaccattccaacaccggatccctcgagagggatgaagtgttcgtccccaagaagaaaaccgacatcaagtggtacggaaagtacctcaacaaccctgtgggtcgcaccgggatgttaacggttcaggtcactctcggctggcctgtgtaattag

SEQ ID NO: 22347 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcccgctcggctgccctttgtgcttag

SEQ ID NO: 22348 - DNA, 356 bp, Artificial
  Mutation in BnaC.FAD2.b introduced by TALE nuclease pair BnFAD2_T02
cctctcctccctcaccctctctcctacttcgcctggcatctctaatgggcctgccaagggagcgtcctaaccggcgtctgggtcatagcccacgagtgcggccaccacgccttcagcgaccaccagtggctggacgactgcgtgggcctcgtcttccactccttcctcctcgtcccttacttctcctggaagccaccgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcgtctgtcctttgtacttag

SEQ ID NO: 22349 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22350 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggcctcctcttccactccttcctcctcgtcccttacttctcctggaagcagtcatcgacgccaccattccaacactggctccctcgagagagacgaagtgtttgtccccaagaagaaatccgacatcaagtggtacggaaagtacctcaacaacccgctagagcgctcggagatgctaaccgtccagttcacgctcggctggcctttgtacttag

SEQ ID NO: 22351 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcttcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaagtcagacatcaagtggtacggcaagtacctcaacaaccctgtgggacgcaccgtgatggtaacggatcagttcactctcggcgggcctttgtacttag

SEQ ID NO: 22352 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaccatcgacgccaccattccaacaccggatccctcgagagggatgaagtgttcgtccccaagaagaaatccgacatcaagtgttacggaaagtacctcaacaacccgctaggacgcacggtgatgctaaccgtccagttcacgctcggctgccctgtgtacttag

SEQ ID NO: 22353 - DNA, 436 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcggtggtttttttgtttgcaagcagcagattacgcgcagaaaaaaaggatctcaagtgaccttaggcgacttttgaacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22354 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22355 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22356 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccatgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22357 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactgccagtggctggacgacaccgtcggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22358 - DNA, 357 bp, Artificial
  Mutation in BnaC.FAD2.b introduced by TALE nuclease pair BnFAD2_T02
cctctcctccctcaccctctctcctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22359 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22360 - DNA, 315 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcggtgacaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22361 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtggctccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22362 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagcaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22363 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22364 - DNA, 397 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagagactaccagtggctggacgacaccgtcggcctcatcttccactccttcctcctcgtcccttacttctcctggaagtaccagcggtggtttgtttgccggaaaaagagttggtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22365 - DNA, 359 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22366 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctagggcgtacggtgatgctaaccgtccagttcacgctcggctggcctttgtacttag

SEQ ID NO: 22367 - DNA, 355 bp, Artificial
  Mutation in BnaC.FAD2.b introduced by TALE nuclease pair BnFAD2_T02
cctctcctccctcacactctctcctacttcgcctgtcctctctactgggcctgccaagggttcgtccttaccggcgtctgggtcatagcccacgagtgcggccaccacgccttcagcgactaccagtggctggacgacaccgtcggcctcatcttccactccttcctcctcgtcccttacttctccttgagtcatcgacgccaccattccaacaccggatccctcgagagggatgaagtgttcgtccccaagaagaaatccgacatcaagtggtacggaaagtacctcaacaacccgctaggacgctcggtgatgctaaccgtccaattcacgctcggctggccttggtactgag

SEQ ID NO: 22368 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggaagttccatcgacgccaccattccaacaccggatccctcgagagggatgaagtgttcgtccccaagaagaaacccgacatcgagtggttcggaaagtacctcagcaagccgcctagacggacgctgagtctaaccgcccaggtcaggctcggctggccttagcgcctag

SEQ ID NO: 22369 - DNA, 326 bp, Artificial
  Mutation in BnaC.FAD2.b introduced by TALE nuclease pair BnFAD2_T02
cctctcctccctcaccctctcccttacctcgcctggcccctctactgggcctgcaaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22370 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22371 - DNA, 357 bp, Artificial
  Mutation in BnaC.FAD2.b introduced by TALE nuclease pair BnFAD2_T02
cctctcctccctcaccctctcccttacctcgcctggcctctctactgggcctgccagagctgcgtcctaaccggcgtctgggtcatagcccacgaatgcggccaccacgccttcagcgactaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 22372 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 22373 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcagcaagccgcttggacgcacggtgatgctaaccggccgggtcaggctcggctgcccttagtacttag

SEQ ID NO: 22374 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaattgttggcccccaagaagaagtcagacatcaagtggtacggaaagttccgcagcaacccgtgaggacgggcgttaaggctaaccggccagttcacgctcggctggcctttgtacttag

SEQ ID NO: 22375 - DNA, 353 bp, Artificial
  Mutation in BnaC.FAD2.b introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaaatcgacgccaccattccaacaccggatccctcgagagggatgaggtgttcgtccccaagaagaaatccgacatcaagtggtacggaaagtacctcaacaacccgctaggacgcacggtgatgctaaccgtgcaggtcacgcgcggctggcctgtatacttag

SEQ ID NO: 22376 - DNA, 342 bp, Artificial
  Mutation in BnaC.FAD2.b introduced by TALE nuclease pair BnFAD2_T02
cctctcctccctcaccctctcacctacttcgcctggcatctctcatgggcctgccagggctgcgtcctaccgggcctctgggtcatcgcccacgaatgcggccaccacgccttcagcgaccaccagtggctggacgacgccgtgggcctcgtcttccactccttcctactcgtcccttacttctcctggaagtaccggataccggatccctcgagagggatgaagtgttcgtccccaagaagaagtcagacatcaagtggtacggaaagtgcctcaacaacccgctaggtcgcacggggatgctaatcgtgcatgtcatgctcgggtggcatgaatacttag

SEQ ID NO: 22377 - DNA, 401 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtactgcccgctttccagtcgggaaacctgtcgtgccagctgcaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22378 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22379 - DNA, 355 bp, Artificial
  Mutation in BnaC.FAD2.b introduced by TALE nuclease pair BnFAD2_T02
cctctcctccctcaccctctcccttacctcgcctggcacctctcctgagcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacgggaatgctaaccttccagttcacgctcggctggcctttgtacttag

SEQ ID NO: 22380 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggggaggctaaccggccagttctcgctcggcgggccttgttacttag

SEQ ID NO: 22381 - DNA, 362 bp, Artificial
  Mutation in BnaC.FAD2.b introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaattacagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcactctcggctggcctttgtacttag

SEQ ID NO: 22382 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22383 - DNA, 348 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggggatgctaaccgtccaggtcacgcgcggctggcatgagtacttag

SEQ ID NO: 22384 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22385 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggccacgtcttccactccttcctcctcgtcccttacttctcctggaccatcgacgccaccattccaacaccggatccctcgagagggatgaagtgttcgtccccaagaagaaagccgacatcaagtggtacggaaagtacctcaacaacccgctagtacgcacggtgaggctaaccgtccagttcacgctcggctggcctatgtacttag

SEQ ID NO: 22386 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22387 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 22388 - DNA, 357 bp, Artificial
  Mutation in BnaC.FAD2.b introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacaccggatccctcgagagggatgaagggttcgtccccaagaagaaatccgacatcaagtggtacggaaagtacctcaacaacccgctaggacgcacggtgatgctaaccttccaggtcacgctcggctggcctgagtacttag

SEQ ID NO: 22389 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggcaagtacctcaacaaccctgtgggacgcaccgtgaggttaacggtgcagttcactctcggctggcctttgtacttag

SEQ ID NO: 22390 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctccgcgtcccttacttctcctggaatcatcgacgccaccattccaacactggctccctcgagagagacgaagtgttcgtccccaagaagaaatccgacatcaagtggtacggaaagtacctcaacaacccgctaggacgcacggttatgctaaccgtccagttcacgctcggctggcctttgtacttag

SEQ ID NO: 22391 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaagtcagacatcaagtggtacggcaagtacctcaacacccctttgggacgcaccgggatgttaacggttcagttcactctcggctggcctttgtacttag

SEQ ID NO: 22392 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 22393 - DNA, 393 bp, Artificial
  Mutation in BnaC.FAD2.b introduced by TALE nuclease pair BnFAD2_T02
cctctcctccctcccctctcccttacctcgcctggcccctctactgggcctgccaaggctgcgtcctaacgggcctctgggtaatcgcccacgaatgcggccaccacgccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22394 - DNA, 355 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagagacgaagtgtttgtccccaagaagaaatccgacatcaagtggtacggaaagtacctcaacaacccgctaggacgcacggtgatgctaaccgtccaggtcacgctcggctggcctgtgtacttag

SEQ ID NO: 22395 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgtgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaagccgacatcaagtggtacggaaagtaccgcaagaaccggtgaggacgaacggttatgctaaccggccaggtcacgcttgggtggcatgtgtacttag

SEQ ID NO: 22396 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggggatgctaaccgtccaggtcacgctcggctggcctttgtacttag

SEQ ID NO: 22397 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22398 - DNA, 355 bp, Artificial
  Mutation in BnaC.FAD2.b introduced by TALE nuclease pair BnFAD2_T02
cctctcctccctcaccctctctcctacttcgcctgccctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggggaggctaaccgtccagttcacgctcggcgggcctttgtacttag

SEQ ID NO: 22399 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 22400 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22401 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22402 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22403 - DNA, 384 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacgccgaggcgacacacgaagcgatcgttggcgtcggcaaacacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22404 - DNA, 356 bp, Artificial
  Mutation in BnaC.FAD2.b introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaggtcatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22405 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 22406 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctattccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22407 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 22408 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggagccatcgacgccaccattccaacaccggatccctcgagagggatgtagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22409 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22410 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22411 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22412 - DNA, 358 bp, Artificial
  Mutation in BnaC.FAD2.b introduced by TALE nuclease pair BnFAD2_T02
cctctcctccctcacactctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 22413 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggtcatcgacgccaccattccaacaccggatccctcgagagggatgaagtgttcgtccccaagaagaaatccgacatcaagtggtacggaaagtacctcaacaacccgctaggacgcacggtgatgctagccgtccagttcacgctcggctggcctttgtacttag

SEQ ID NO: 22414 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggacccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22415 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcacgctcggctggcctttgtacttag

SEQ ID NO: 22416 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgactacaccgtcggtctcatcttccactccttcctcctcatcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcgcgctcggctggcctgtgtacttag

SEQ ID NO: 22417 - DNA, 355 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatcagacatcaagtggtacggcaagtaccgcaacaaccctttgggacgcaccgtgatggtaacggttcagttcagtctcgggtggcatgtgtacttag

SEQ ID NO: 22418 - DNA, 365 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctgtgtacttag

SEQ ID NO: 22419 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22420 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22421 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcgcggtgatgctaaccgttcagttcacgctcggctggcctttgtacttag

SEQ ID NO: 22422 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggatgcgtcctaaccggcgtctgggtcatagcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctatgtgcttag

SEQ ID NO: 22423 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgaccaccagtggctggacgacgccgtgggcctcgtcttccactccttcctcctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22424 - DNA, 358 bp, Artificial
  Mutation in BnaC.FAD2.b introduced by TALE nuclease pair BnFAD2_T02
cctctcctccctcaccctctcccttacctcgcctggccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22425 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22426 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22427 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacctcaagtggtacggaaagtacctcaacaacccgctaggacgcacggtgatgctaaccgtccagttcacgctcggctgccctttgtacttag

SEQ ID NO: 22428 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtaccgcaacaacccgctgggacgcacggtgatgctaacctgccagttcacgctcggctggcatgaatacgtag

SEQ ID NO: 22429 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaaagccatcgacgccaccattccaacaccggatccctcgagagggatgaagtgttcgtccccaagaagaaagccgacatcaagtggtacggaaaggacctcaacaacccgctaggacgcacggtgatgctaatcgtccatgtcacgctcggctggcctgagtacttag

SEQ ID NO: 22430 - DNA, 402 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22431 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttccctctcggctgccctttgcacttag

SEQ ID NO: 22432 - DNA, 359 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22433 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcatcgacgccacccttccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22434 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 22435 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaacctgcgtctgggtcatagcccacgagtgcggccaccacgccttcagcgactaccagtggctgcacgacaccgtcggcctcatcttccactccttcctcctcgtcccttacttctcctggaagggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcatttgtacttag

SEQ ID NO: 22436 - DNA, 342 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtaccggataccggatccctcgagagggatgaagtgttcgtccccaagaagaaatccgacatcaagtggtacggaaagtacctcaacaacccgctaggacgcacggggatgctaaccgtccagttcacgctcggctggcctgtgtacttag

SEQ ID NO: 22437 - DNA, 315 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22438 - DNA, 394 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcaggctcggctggcctttgtacttag

SEQ ID NO: 22439 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccacaagaagaaatccgacatcaagtggtacggaaagtacctcaacaacccgctaggacgcacggtgatgctaaccgtccagttcacgctcggctggcctttgtacttag

SEQ ID NO: 22440 - DNA, 336 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcatcgtcttccactccttcctcctcgtcatcgacgccaccattccaacactggctccctcgagagagacgaagtgtttgtccccaagaagaaatccgacatcaagtggtacggaaagtacctcaacaacccgctaggacgcacggagaggctaaccgtccagttcacgcgcgggtggcctttatacttag

SEQ ID NO: 22441 - DNA, 355 bp, Artificial
  Mutation in BnaC.FAD2.b introduced by TALE nuclease pair BnFAD2_T02
cctctcctccatcaccctctcccttacctcgcctggcccctctactgggcctgccaaggctgcgtcctaacgggcctctgggtcatcgcccacgaatgcggccaccacgccttcatcgaccaccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22442 - DNA, 322 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctccaccattccaacactggctccctcgagagggatgaagtgttcgtccccaagaagaaatccgacatcaagtggtacggaaagtacctcaacaacccgctaggacgcgcggtgatgctaaccgtccagttcacgctcggctggcctttgtacttag

SEQ ID NO: 22443 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcctctgggtcatcgcccacgaatgcggccaccacgccttcagcgaccaccagtggctggacgacgccgtgggcctcgtcttccactccttcctcctcgtcccttacttctcctggaaacatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22444 - DNA, 362 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagccatcgacgccaccattccaacaccggatccctcgagagggatgaagtgttcgtccccaagaagaaatccgacatcaagtggtacggaaagtacctcaacaacccgctaggacgcgcggggatgctaaccgtccaggtcacgctcggctggcctttgtacttag

SEQ ID NO: 22445 - DNA, 365 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagctccctcagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22446 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgtcaggtcgctcgatgaggctaaccgtccagttcacgctcggctggccttagtacttag

SEQ ID NO: 22447 - DNA, 336 bp, Artificial
  Mutation in BnaC.FAD2.b introduced by TALE nuclease pair BnFAD2_T02
cctctcctccctcaccatctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22448 - DNA, 356 bp, Artificial
  Mutation in BnaC.FAD2.b introduced by TALE nuclease pair BnFAD2_T02
cctctcctccctcaccctctcccttacctcgcctggcccccctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22449 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagttgctggacgacgccgtgggcctcgtcttccactccttcctcctcgtcccttacttctcctggaagttggttgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22450 - DNA, 350 bp, Artificial
  Mutation in BnaC.FAD2.b introduced by TALE nuclease pair BnFAD2_T02
cctctcctccctcaccctctcccttacctcgcctggcctctctactgggcctgacaaggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacgggaatgctaaccgtccagctcacgctcggctggcctttgtacttag

SEQ ID NO: 22451 - DNA, 412 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcacagcaccggcaccagccgcgggaccaggaaccgtaaaaaggccgcgttgcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22452 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctaaccatccaggtcacgctcggctggccttagtacttag

SEQ ID NO: 22453 - DNA, 346 bp, Artificial
  Mutation in BnaC.FAD2.b introduced by TALE nuclease pair BnFAD2_T02
cctctcctccctcaccctgtcccttacctcgcctggcccctctactcggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgatgctatccgtccagttctcgctcggctggcctttgtacttag

SEQ ID NO: 22454 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagctaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22455 - DNA, 359 bp, Artificial
  Mutation in BnaC.FAD2.b introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgggcggtgattctaaccgtccatttcacgctcggctggccttagtacttag

SEQ ID NO: 22456 - DNA, 356 bp, Artificial
  Mutation in BnaC.FAD2.b introduced by TALE nuclease pair BnFAD2_T02
cctctcctccctcaccctctcacttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaaggacctcaacaaccctgggggacgcaccgtgatgttaagggtgcagttcactctcggctgtcctttgtacttag

SEQ ID NO: 22457 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22458 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaatcatcgacgccaccattccaacactggctccctcgagagggatgaagtgttcgtccccaagaagaaatccgacatcaagtggtacggaaagtacctcaacaacccgctaggacgcacggttatgctaaccgtccagttcacgctcggctggcctttgtacttag

SEQ ID NO: 22459 - DNA, 362 bp, Artificial
  Mutation in BnaC.FAD2.b introduced by TALE nuclease pair BnFAD2_T02
ctctcctccctcaccctctcccttacctcgcctggcacctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 22460 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22461 - DNA, 357 bp, Artificial
  Mutation in BnaC.FAD2.b introduced by TALE nuclease pair BnFAD2_T02
cctctcctccctcaccctctctcctacttcgcctggcccctctactgagcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaacccgctaggacgcacggtgatactaaccgtccagttcacgctcggctggcctttgtacttag

SEQ ID NO: 22462 - DNA, 352 bp, Artificial
  Mutation in BnaC.FAD2.b introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 22463 - DNA, 311 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgtctttgtccccaagaagaagtcagacatcaagtggtacggcaagtacctcaacaaccctttgggacgcacggtgatgctaaccgtccagttcacgctcggctggcctttgtacttag

SEQ ID NO: 22464 - DNA, 394 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22465 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22466 - DNA, 359 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcgtggaagtagccatcgacgccaccattccaccaccggatccctcgagagggatgaagtgttcgtccccaagaagaaatccgacatgaagtggtacggaaagtacctcaacaacccgctaggacggcctgtgatgctaacaggccaggtcacgctcggctggcctttgtccgtag

SEQ ID NO: 22467 - DNA, 362 bp, Artificial
  Mutation in BnaC.FAD2.b introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 22468 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22469 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctcacttctcctgaagtcatcgacgccaccattccaacaccggatccctcgagagggatgaagtgttcatccccaagaagaaatccgacatcaagtggtacggaaagtacctcaacaacccgctaggacgcacggtgatgctaaccgtccagttcacgcgcggctggcctttgtacttag

SEQ ID NO: 22470 - DNA, 326 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttgagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22471 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgattctaaccgtccagttcacgctcggctggcctttgtacttag

SEQ ID NO: 22472 - DNA, 356 bp, Artificial
  Mutation in BnaC.FAD2.b introduced by TALE nuclease pair BnFAD2_T02
cctctcctccctcaccctctcccttacctcgcctggcccctctactgagcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcagcaacccgctaggacgcacggtgatgctaaccgtccagttcacgctcggctggcctttgtacttag

SEQ ID NO: 22473 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22474 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 22475 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagggatgaagtgttcgtccccaagaagaaatccgacatcaagtggtacggaaagtacctcaacagcccgctaggacgcacggtgatgctaaccgtccagttcacgctcggctggcctttgtacttag

SEQ ID NO: 22476 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcttcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22477 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22478 - DNA, 312 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22479 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctagtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22480 - DNA, 359 bp, Artificial
  Mutation in BnaC.FAD2.b introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagaagccatcgacgccaccattccaacaccggatccctcgagagggatgaagtgttcgtccccaagaagaaatccgacatcaagtggtacggaaagtacctcaacaacccgctaggtcgcacggggatgctaaccgtccatttcacgcgcggctggccttagtacttag

SEQ ID NO: 22481 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattacaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22482 - DNA, 347 bp, Artificial
  Mutation in BnaC.FAD2.b introduced by TALE nuclease pair BnFAD2_T02
cctctcctccctcaccctctctcctacttcgcctggcctctctactgcgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttat

SEQ ID NO: 22483 - DNA, 357 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 22484 - DNA, 358 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgcgcggctggcctttgtacttag

SEQ ID NO: 22485 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgtttgtccccaagaagaaatccgacatcaagtggtacggaaagtacctcaacaacccgctaggacgcacggtgatgctaaccttccatttcacgctcggctggcctttgtacttag

SEQ ID NO: 22486 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22487 - DNA, 438 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacctgcctctgggtcatcgcccacgaatgcggccaccacgccttcagcgaccaccagtggctggacgacgccgtgggcctcgtcttccactccttcctcctcgtcccttacttctcctggaatccgactgagcctttcggtttatctgttgtttgtaggtgaacgctagcctgagtaggctccgcccccctgacgagcatcacagccatcgacgccaccataccaacaccggagccctcgagagggatgaagtgtgcgtccccaagaagaaatccgacatcaagtggcacgacaagtacctcaacaacccggtaggcagcacggtaaggctaaccgtccagttcacgctcggctgccctttgtacgtag

SEQ ID NO: 22488 - DNA, 332 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 22489 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22490 - DNA, 408 bp, Artificial
  Mutation in BnaC.FAD2.b introduced by TALE nuclease pair BnFAD2_T02
cctctcctccctcaccctctctcctacttcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcctttcgttttaattgatgcctggcagttccctattctcgtgttgaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttctcgctcggctggcctttgtacttag

SEQ ID NO: 22491 - DNA, 362 bp, Artificial
  Mutation in BnaC.FAD2.b introduced by TALE nuclease pair BnFAD2_T02
cctctcctccctcaccctctctcctacttcgcatgtcctctctactgggcctgccaacggtgcgtcctaacgggcctctgggtaatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaagtcagacatcaagtggtacggcaagtaccgcaaccaccgtcagagacgcacaatgatcttacccgcccagttcactctcggctggcctttgtacttag

SEQ ID NO: 22492 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagttgtacggaaagtacctcaacaacccgctaggacgcacggtgatgctaaccgtccagttcacgctcggctggcctttgtacttag

SEQ ID NO: 22493 - DNA, 435 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttggacacaggccaacttctcaagattgcaaaacgtggcggcgtgaccgcagtggaggcagtgcatgcatggcgtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22494 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22495 - DNA, 353 bp, Artificial
  Mutation in BnaC.FAD2.b introduced by TALE nuclease pair BnFAD2_T02
cctctcctccctcaccctctcccttacctcgccttgcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacaccggatccctcgagagggatgaagtgttcgtccccaagaagaaaaccgacatcaagtggtacggcaagtacctcaacaaccctgtgggacgcaccgggaggttatcggtgcagttcactcccggctggccttggtacgtag

SEQ ID NO: 22496 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22497 - DNA, 391 bp, Artificial
  Mutation in BnaC.FAD2.b introduced by TALE nuclease pair BnFAD2_T02
cctctcctccctcaccctgtctactacttcgcctggcctctctactcggcctgccaaggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtacaatgttccagattacgctatcgatatcgccggccatcgacgccaccattccaacaccggatccctcgagagggatgaagtgttcgtccccaagaagaaatccgacatcaagtggtacggaaagtaccgcaacaacccgcgaggacgcgcggtgatgctaaccgcccaggtcacgcgtcggtggcctttgcacgtag

SEQ ID NO: 22498 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaaggatgcgtcctaaccggcgtctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22499 - DNA, 353 bp, Artificial
  Mutation in BnaC.FAD2.b introduced by TALE nuclease pair BnFAD2_T02
cctctcctccctcaccctctcttctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22500 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22501 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22502 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctttgtacttag

SEQ ID NO: 22503 - DNA, 362 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtaccgcaacaaccctttgggacgcaccgtgatgttaacggttcagttcactctctgctggccgttgtacttag

SEQ ID NO: 22504 - DNA, 353 bp, Artificial
  Mutation in BnaC.FAD2.b introduced by TALE nuclease pair BnFAD2_T02
cctctcctccctcaccctctacattacctcgcctggcccctctactgggcctgccaaggctgcgtcctaacgggcctatgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggccgttgtacttag

SEQ ID NO: 22505 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22506 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaaagccatcgacgccaccattccaacaccggattcctcgagagggatgaagtgttcgtccccaagaagaagtcagacatcaagtggtacggcaagtaccccaacaaccctgtgggacgcaccgtgatgttaacggttcagttcactctcggctggcctttgtacttag

SEQ ID NO: 22507 - DNA, 471 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccagcaataatggtggcaagcaggcgctggagacggtccagcggctgttgccggtgctgtgccaggcccacggcttgaccccccagcaggtggtggccatcgccagcaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22508 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgtggccaccacgccttcagcgactaccagtggctggacgacaccgtcggcctcatcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22509 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcacgctcggctggcctttgtacttag

SEQ ID NO: 22510 - DNA, 274 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22511 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22512 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctccggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcccggctggccttagtacttag

SEQ ID NO: 22513 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22514 - DNA, 326 bp, Artificial
  Mutation in BnaC.FAD2.b introduced by TALE nuclease pair BnFAD2_T02
cctctcctccctcaccctataccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22515 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgatagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22516 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22517 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22518 - DNA, 350 bp, Artificial
  Mutation in BnaC.FAD2.b introduced by TALE nuclease pair BnFAD2_T02
cctctcctccctcaccctcccccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22519 - DNA, 394 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgatcggctggcctttgtacttag

SEQ ID NO: 22520 - DNA, 356 bp, Artificial
  Mutation in BnaC.FAD2.b introduced by TALE nuclease pair BnFAD2_T02
cctctcctccctcaccctctctcctacttcgcctggcccccctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22521 - DNA, 356 bp, Artificial
  Mutation in BnaC.FAD2.b introduced by TALE nuclease pair BnFAD2_T02
cctctcctccctcaccctctctcctacttcgcctggcctctctcctgagcctgccagggctgcgtcctaaccagcgtctgggtcatagcccacgagtgcggccaccccgccttcagcgactaccagtggctggacgacaccgtcggcctcctcttccactccttcctcctcgtcccttacttctcctggaagccatcgacgccaccattccaacaccggatccctcgagagggatgaagtgttcgtccccaagaagaaatccgacatcaagtggtacggaaagttccgcaacgtcccgcgtggacgcgcggtggggctaaccgcccaggtcacgcccgggtggccttagcacttag

SEQ ID NO: 22522 - DNA, 359 bp, Artificial
  Mutation in BnaC.FAD2.b introduced by TALE nuclease pair BnFAD2_T02
cctccctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 22523 - DNA, 356 bp, Artificial
  Mutation in BnaC.FAD2.b introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22524 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22525 - DNA, 412 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgctgaaccacatcaccaactgcaacggccccgtgctgtccgtggaggagctccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22526 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgtggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22527 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 22528 - DNA, 356 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgcaagggcgcacggggaacctaaccgtccagttcacgctcggctggcctttgtacttag

SEQ ID NO: 22529 - DNA, 355 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22530 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgcctccagcgaccaccagtggctggacgacgccgggggcctcgtcttccactccttcctcctcgtcccttacttctcctggaagttatcagccatcgacgccaccattccaacaccggatccctcgcgagggatgaagtgctcgtccccaagaagaagccacacctcaagtggtacggcaagtacctcaacatccctttgggacgcaccgtgatgttaacggttcagttccctcccggctggcctctgtacttag

SEQ ID NO: 22531 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22532 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccatagacgccaccattccaacaccggatccctcgagagggatgaagtgttcgtccccaagaagaagtcagacatcaagtggtacggcaagtacctcaacaaccctttgggacgcaccgtgatgttaacggttcagttcactcccggctggcctttgtacttag

SEQ ID NO: 22533 - DNA, 355 bp, Artificial
  Mutation in BnaC.FAD2.b introduced by TALE nuclease pair BnFAD2_T02
cctctcctccctcaccctctctcctacttagcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22534 - DNA, 357 bp, Artificial
  Mutation in BnaC.FAD2.b introduced by TALE nuclease pair BnFAD2_T02
cctctcctccctcaccctctcccttacctcgcctggcccctctcctgagcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggccttagcacttag

SEQ ID NO: 22535 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22536 - DNA, 347 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22537 - DNA, 356 bp, Artificial
  Mutation in BnaC.FAD2.b introduced by TALE nuclease pair BnFAD2_T02
cctctcctccctcaccctctcccttacctcgcctggccactctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggggatgctaaccgtccatgtcacgcgcggctggcctttgtacttag

SEQ ID NO: 22538 - DNA, 363 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22539 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgctgtgggcctcgtcttccactccttcctcctcgtcccttacttctcctggaaagccatcgacgccaccattccaacaccggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22540 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22541 - DNA, 390 bp, Artificial
  Mutation in BnaC.FAD2.b introduced by TALE nuclease pair BnFAD2_T02
cctctcctccctcaccctctcccttacctcgcctggacactctactgggcctgccaaggctgcgtcctaacgggcctctgggtcatcccccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcccggcgggcctttgtactta

SEQ ID NO: 22542 - DNA, 310 bp, Artificial
  Mutation in BnaC.FAD2.b introduced by TALE nuclease pair BnFAD2_T02
cctctcctccctcaccctctctcctacttcgcctggcccctccactgggcctgccaagggcgcgtcctaaccggcgtctgggtcatagcccacgagtgcggccaccacgccttcagcgactaccagtggcttgacgacaccgtcggtcatcgacgccaccattccaacaccggatccctcgagagggatgaagtgttcgtccccaagaagaaatccgacatcaagtggtacggaaagtacctcaacaacccgctaggacgcggggtgaggctaaccgtccaagtcacgcacggctggcgttaggaattag

SEQ ID NO: 22543 - DNA, 352 bp, Artificial
  Mutation in BnaC.FAD2.b introduced by TALE nuclease pair BnFAD2_T02
cctctcctccctcaccatctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22544 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22545 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22546 - DNA, 359 bp, Artificial
  Mutation in BnaC.FAD2.b introduced by TALE nuclease pair BnFAD2_T02
cctctcctccctcaccctctcccttacctcgcctgggccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22547 - DNA, 351 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 22548 - DNA, 363 bp, Artificial
  Mutation in BnaC.FAD2.b introduced by TALE nuclease pair BnFAD2_T02
cctctcctccctcaccctctcccctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacaccggatccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22549 - DNA, 355 bp, Artificial
  Mutation in BnaC.FAD2.b introduced by TALE nuclease pair BnFAD2_T02
cctctcctcctcaccctctctcctacttcgcctggcccctctactgggcctgccaaggctgcgtcctaaccggcgtctgggtcatagcccacgagtgcggccaccacgccttcagcgactaccagtggcttgacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 22550 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22551 - DNA, 356 bp, Artificial
  Mutation in BnaC.FAD2.b introduced by TALE nuclease pair BnFAD2_T02
cctctcctccctcaccctctctcctacttcgtctgtcctctctactgggcctcctaggcctgcgtcctaaccggcctctgggtcatagcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcagcaagcggctgggacgcacggtaatgctacccgcccagttcacgctcggctggcctttgtacttag

SEQ ID NO: 22552 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22553 - DNA, 274 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22554 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgttaaccgtccagttcacgctcggctggcctttgtacttag

SEQ ID NO: 22555 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22556 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactcgcggctggcctttgtacttag

SEQ ID NO: 22557 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 22558 - DNA, 315 bp, Artificial
  Mutation in BnaC.FAD2.b introduced by TALE nuclease pair BnFAD2_T02
cctctcctccctcaccctctcccttacctcggctggcctctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaaccctttgggacgcacggggatgttaacggttcagttcactctcggctggcctttgtacttag

SEQ ID NO: 22559 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgtacggtgatgctaaccgtccagttcacgctcggctggcctttgtacttag

SEQ ID NO: 22560 - DNA, 435 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcgtctgggtcatagcccacgaatgcggccaccacgccttcagcgaccaccagtggctggacgacgccgtgggcctcgtcttccactccttcctcctcgtcccttacttctcctggaagttggacacaggccaacttctcaagattgcaaaacgtggcggcgtgaccgcagtggaggcagtgcatgcatggcgtacagccatcgacgccaccattccaacaccggatccctcgagagggatgaagtgttcgtccccaagaagaaatccgacatcaagtggtactgaaagtacctcaacaacccgctaggacgcacggtgatgctaaccgtccagttcacgctcggctggcctttgtacttag

SEQ ID NO: 22561 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22562 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcccggctgcccttagtacttag

SEQ ID NO: 22563 - DNA, 362 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22564 - DNA, 345 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22565 - DNA, 357 bp, Artificial
  Mutation in BnaC.FAD2.b introduced by TALE nuclease pair BnFAD2_T02
cctctcctccctcaccctctcccttacctcgcctcgcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtactgcaagtacctcaacaaccctttgggacgcaccgtgatgttaacggttcagttctgtcgcggctggcctttgtacttag

SEQ ID NO: 22566 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22567 - DNA, 369 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22568 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcactcgcggctggcctttgtacttag

SEQ ID NO: 22569 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttgaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 22570 - DNA, 355 bp, Artificial
  Mutation in BnaC.FAD2.b introduced by TALE nuclease pair BnFAD2_T02
cctctcctccctcaccctttctactacttcgcctggcctctctactgcgcctgccaaggctgcgtcctaaccggcgtctgggtcatagcccacgagtgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaaatccgacatcaagtggtacggaaaggaccgcaacaacccgctaggacgcacggtgatgctaaccgtccaggtcacgcgcggctggcctttgtacttag

SEQ ID NO: 22571 - DNA, 357 bp, Artificial
  Mutation in BnaC.FAD2.b introduced by TALE nuclease pair BnFAD2_T02
cctctcctccctcaccctctcccttacctcgcttggcccctctactgggcctgccaaggctgcgtcctaacgggcctctgggtcatcgcccacgaatgcggccaccacgccttcagcgaccaccagtggctggacgacgccgtgggcctcttcttccactccttcctcctcgtcccttacttctcctggaaagccatcgacgccaccattccaacaccggatccctcgagagggatgaagtgttcgtccccaagaagaagtcagacatcaagtggtacggcaagtccctcaacaacactttgggaggcaccgggattttaacggttccgttcacgcccggctgccctttgtccttag

SEQ ID NO: 22572 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 22573 - DNA, 389 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaacgtcggttcgagattgcgctcgaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22574 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcccggctggcctttgtacttag

SEQ ID NO: 22575 - DNA, 393 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtacatgttctttcctgcgttatcccctgattctgtggatatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22576 - DNA, 353 bp, Artificial
  Mutation in BnaC.FAD2.b introduced by TALE nuclease pair BnFAD2_T02
cctctcctccctcaccctatccattacctcgcctggcccatctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcttgccttggtacttag

SEQ ID NO: 22577 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcctctgggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22578 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggccgttgtacttag

SEQ ID NO: 22579 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22580 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcacgcttggctggcctttgcacttag

SEQ ID NO: 22581 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccaggtcacgcgcggctggccgttgtacttag

SEQ ID NO: 22582 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22583 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 22584 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcaataatggtggcaagcaggcgctggatccatcgacgccaccattccaacaccggatccctcgagagggatgaagttttcgtccccaagaagaaatccgacatcaagtggtacggcaagtacctcaacaaccctttgggacgcaccgtgatgttaacggttcagttcactctcggctggcctttgtacttag

SEQ ID NO: 22585 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaagactgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22586 - DNA, 351 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22587 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22588 - DNA, 356 bp, Artificial
  Mutation in BnaC.FAD2.b introduced by TALE nuclease pair BnFAD2_T02
cctctcctccctcaccctctcccttacatcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 22589 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 22590 - DNA, 400 bp, Artificial
  Mutation in BnaC.FAD2.b introduced by TALE nuclease pair BnFAD2_T02
cctctcctccccaccctctcccttacctcggctggcccctctactgggcctgccaaggctgcgtcctaacgggcctctgggtcatcgcccacgaatgcggccaccccgccttcagcgaccaccagtggctggacgacgccgtgggcctcgtcttccactccttcctcctcgtcccttacttctcctggaagtactgcccgctttccagtcgggaaacctgtcgtgccagctgcaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22591 - DNA, 412 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctgaaccacatcaccaactgcaacggcgccgtgctgtccgtggaggagctccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22592 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22593 - DNA, 389 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22594 - DNA, 351 bp, Artificial
  Mutation in BnaC.FAD2.b introduced by TALE nuclease pair BnFAD2_T02
cctctcctccctcccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctgaagccatcgacgccaccattccaacaccggatccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22595 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacaccggatccctcgagagggatgaagtgtttgtccccaagaagaagtccgacatcaagtggtacggaaagtacctcaacaacccgctaggacgcacggtgatgctaaccgtccagttcacgctcggctggcctttgtacttag

SEQ ID NO: 22596 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22597 - DNA, 362 bp, Artificial
  Mutation in BnaC.FAD2.b introduced by TALE nuclease pair BnFAD2_T02
cctctcctccctcaccctctctcctacttcgcctagcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcgcgcgcggctggcctttgtacttag

SEQ ID NO: 22598 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggccttgtacttag

SEQ ID NO: 22599 - DNA, 358 bp, Artificial
  Mutation in BnaC.FAD2.b introduced by TALE nuclease pair BnFAD2_T02
cctctcctccctcaccctctctcctacttcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22600 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacagccatcgacgccaccattccaacaccggatccctcgagagggatgaagtgttcgtccccaagaagaaatccgacatcaagtggtactgaaagtacctcaacaacccgctaggacgcacggtgatgctaaccgtccagttcacgctcggctggcctttgtacttag

SEQ ID NO: 22601 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 22602 - DNA, 343 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22603 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22604 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactcgcggctggcctttgtacttag

SEQ ID NO: 22605 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 22606 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22607 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggcaagtacctcaacaaccctttgggacgcaccgtgatgttaaccgtccagttcacgctcggctggcctttgtacttag

SEQ ID NO: 22608 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgcctttgtacttag

SEQ ID NO: 22609 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacggggctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaagccgctaggacgcacggtgatgctaaccgtccagttcacgctcggctggcctttgtacttag

SEQ ID NO: 22610 - DNA, 360 bp, Artificial
  Mutation in BnaC.FAD2.b introduced by TALE nuclease pair BnFAD2_T02
cctctctctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22611 - DNA, 359 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22612 - DNA, 355 bp, Artificial
  Mutation in BnaC.FAD2.b introduced by TALE nuclease pair BnFAD2_T02
cctctcctccctcaccctctctcctacttcgcctggcctctctcctgagcctgcccagggtgcgtcctaaccggcgtctgggtcatagcccacgagtgcggccaccacgccttcagcgactaccagtggcttgacgacaccgtcggtctcctcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 22613 - DNA, 353 bp, Artificial
  Mutation in BnaC.FAD2.b introduced by TALE nuclease pair BnFAD2_T02
cctctcctccctcaccctctcccttacctcgcctggccactctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggccatcgacgccaccattccaacaccggatccctcgagagggatgaagtgttcgtccccaagaagaaatcccacatcaagtggtacggaaagtacctcaacaacccgctaggacgcacggtgattctaaccgtccagttcacgcccggctggcctttgtacttag

SEQ ID NO: 22614 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22615 - DNA, 357 bp, Artificial
  Mutation in BnaC.FAD2.b introduced by TALE nuclease pair BnFAD2_T02
cctctcctccctcaccctttcccttacctcgcctggcccctctactgcgcctgccaaggctgcgtcctaacgggcctctgggtcatcgcccacgaatgcggccaccacgccttcagcgaccaccagtggctggacgacgccgtgggcctcgtcatccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtcgaggtcacgctcggctggcctttgtacttag

SEQ ID NO: 22616 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22617 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccactaggacgcacggtgatgctaaccgtccagttcacgctcggctggcctttgtacttag

SEQ ID NO: 22618 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttatcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 22619 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22620 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggactcacggtgatgctaaccgtccagttcacgctcggctggcctttgtacttag

SEQ ID NO: 22621 - DNA, 291 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22622 - DNA, 367 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtacacacacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22623 - DNA, 356 bp, Artificial
  Mutation in BnaC.FAD2.b introduced by TALE nuclease pair BnFAD2_T02
cctctcctccctcaccctctctactacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22624 - DNA, 394 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22625 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22626 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22627 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22628 - DNA, 356 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccagtccaacaccgtatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 22629 - DNA, 450 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagctgctggagacggtccagcggctgttgccggtgctgtgccaggcccacggcttgaccccccagcaggtggtggccatcgccagcaataatgtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22630 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22631 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattcgacgccaccattccaacaccggatccctcgagagggatgaagtgttcgtccccaagaagaaatccgacatcaagtggtacggaaagtacctcaacaacccgctaggacgcacggtgatgctaaccgtccagttaacgctcggctggcctttgtacttag

SEQ ID NO: 22632 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22633 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctcacgggcctctgggtcatcgcccacgaatgcggccaccacgccttcagcgactaccagtggctggacgacaccgtcggtctcatcttccactccttcctcctcgtcccttacttcttcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22634 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggccactgggtcatcgcccacgaatgcggccaccacgccttcagcgaccaccagtggctggacgacgccgtgggcctcgtcttccactccttcctcctcgtcccttactcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22635 - DNA, 355 bp, Artificial
  Mutation in BnaC.FAD2.b introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22636 - DNA, 333 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22637 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22638 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctaggctggcctttgtacttag

SEQ ID NO: 22639 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggctggcctttgtacttag

SEQ ID NO: 22640 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22641 - DNA, 356 bp, Artificial
  Mutation in BnaC.FAD2.b introduced by TALE nuclease pair BnFAD2_T02
cctctcctcctcaccctcttccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22642 - DNA, 357 bp, Artificial
  Mutation in BnaC.FAD2.b introduced by TALE nuclease pair BnFAD2_T02
cctctactccctcaccctatctcctacttcgcctggccactctactgggcctgccaaggctgcgtcctaacgggcctctgggtcatcgcccacgaatgaggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtagctcaacaacccgctaggacgcacggtgatgctaaccgtccagttcacgctcggctggcctttgtacttag

SEQ ID NO: 22643 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22644 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaaccggctaggacgaacggggatgctaaccgtccagttcaggcacggctggccttagaacttag

SEQ ID NO: 22645 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22646 - DNA, 455 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaccgtctccagcgcctgcttgccaccattattgctggcgatggccaccacctgctggggggtaaagccgtgggcctggcacagcaccggcaacagccgcttggcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22647 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22648 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 22649 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22650 - DNA, 342 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccggataccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22651 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22652 - DNA, 326 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctagtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22653 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcaataatggtggcaagcaggcgctggatccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22654 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22655 - DNA, 362 bp, Artificial
  Mutation in BnaC.FAD2.b introduced by TALE nuclease pair BnFAD2_T02
cctctcctccctcaccctctctcctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtattacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgcttag

SEQ ID NO: 22656 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22657 - DNA, 323 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccgctcgccgcagccgaacgaccgagaagaagtcagacatcaagtggtacggcaagtacctcaacagccctttgggacgcaccgtgatgttaaccgtccagttcacgatcggctggcctttgtacttag

SEQ ID NO: 22658 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgactccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22659 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggaaagtacctcagcaaccggctaggacgcacggtggtgctaaccgtctagttcactctcggctggcctttgtacttag

SEQ ID NO: 22660 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22661 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgtgtcatcgcccacgaatgcggccaccacgccttcagcgaccaccagtggctggacgacgccgtgggcctcgtcttccactccttcctcctcgtcccttacttctcctggatgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22662 - DNA, 404 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatctccagcgcctgcttgccaccgccattgctggcgatggccaccagtcatcgacgccaccattccaacactggctccctcgagagggatgaagtgttcgtccccaagaagaaatccgacatcaagtggtacggcaagtacctcaacagccctttgggacgcaccgtgatgttaacggttcagttcactctcggctggcctttttacttag

SEQ ID NO: 22663 - DNA, 454 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgccccttacttctcctggagtctccagcgcctgcttgccgccatcatatcactgtgtggcttcaggccgccatccactgcggagccgtacaaatgtacggccagcaacgtcggttcgagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22664 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgcctttgtacttag

SEQ ID NO: 22665 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22666 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtaaggaaagtagctcaacaacccggtaggacgtacggggatgctaaccgtccagttcacgctcggctggcctttgtacttag

SEQ ID NO: 22667 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgagtcatcgcccacgaatgcggccaccacgcctcagcgaccaccagtggctggacgacgccgtgggcctcgtcttccactccttcctcctcgtcccttacttctcctggaatatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22668 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 22669 - DNA, 310 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggcttgacgacaccgtcggtcatcgacgccaccattccaacaccggatccctcgagagggatgaagtgttcgtccccaagaagaaatccgacatcaagtggtacggaaagtacctcaacaacccgctatgacgcacggtgatgctaaccgtccagttcacgctcggctggcctttgtacttag

SEQ ID NO: 22670 - DNA, 274 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgccatcaagtggtactgaaagtacctcaacaacccgctaggacgcacggtgatgctaaccgtccagttcacgctcggctggcctttgtacttag

SEQ ID NO: 22671 - DNA, 389 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22672 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctctgctggcctttgtacttag

SEQ ID NO: 22673 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccatgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22674 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttcaactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22675 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacaccggatccctcgagagggatgaagtgttcgtccccaagaagaagtcagacatcaagtggtacggcaagtacctcaacagccctttgggacgcaccgtgatgttaacggttcagttcactctcggctggcctttgtacttag

SEQ ID NO: 22676 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22677 - DNA, 326 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 22678 - DNA, 357 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgttggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22679 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22680 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacatcccgctaggacgcacggtgatgctaaccgtcccgttcacgctcggatgccctttgtacttag

SEQ ID NO: 22681 - DNA, 273 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 22682 - DNA, 343 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctacttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22683 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22684 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22685 - DNA, 353 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22686 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtggacctcgtcttccactccttcctcctcgtcccttacttctcctggaacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22687 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22688 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22689 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 22690 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22691 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22692 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtggctccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22693 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcatggtgatgctaaccgtccaggtcacgctcggctggcctttgtacttag

SEQ ID NO: 22694 - DNA, 412 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccacaagaagaaatccgacatcaagtggtacggaaagtacctcaacaacccgctaggacgcacggtgatgctaaccgtccagttcacgctcggctggcctttgtacttag

SEQ ID NO: 22695 - DNA, 357 bp, Artificial
  Mutation in BnaC.FAD2.b introduced by TALE nuclease pair BnFAD2_T02
cctctcctccctcaccctctctcctacttcgcctaccctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccatgccaacaccggatccctcgagagggatgaagtgttcgtccccaagaagaaatccgacatcaagtggtacggaaagtacctcaacaacccgcttggacgcacggtggtgctaaccgtccagttcacgctcggctggcctttgtacttag

SEQ ID NO: 22696 - DNA, 359 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22697 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22698 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22699 - DNA, 359 bp, Artificial
  Mutation in BnaC.FAD2.b introduced by TALE nuclease pair BnFAD2_T02
cctctcctccctcaccctctcccttacctcgcctgccccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaccccttttgtacgcaccgtaatgttaacggttcagttcactctcggctggcctttgtacttag

SEQ ID NO: 22700 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagtcatcgacgccaccattccaacactggctccctcgagagagacgaagtgtttgtccccaagaagaagtcacacatcaagtggtacggcaagtacctcaacaaccctttgggacgcacggtgatgctaaccgtccagttcacgctcggctggcctttgtacttag

SEQ ID NO: 22701 - DNA, 438 bp, Artificial
  Mutation in BnaC.FAD2.b introduced by TALE nuclease pair BnFAD2_T02
cctctactccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaatccgactgagcctttcgttttatctgttgtttgtcggtgaacgctctcctgagtaggctccgcccccctgacgagcatcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 22702 - DNA, 306 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22703 - DNA, 340 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcttccatcgacgccaccattccaacaccggatccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 22704 - DNA, 330 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22705 - DNA, 274 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22706 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22707 - DNA, 370 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttacttactcgtcccctacaacctgcccatcggccaggccgacgccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22708 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgctgctaaccgtccagttcacgctcggctggcctttgtacttag

SEQ ID NO: 22709 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctctcatccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22710 - DNA, 357 bp, Artificial
  Mutation in BnaC.FAD2.b introduced by TALE nuclease pair BnFAD2_T02
cctctcctccctcaccctctcccttacctcgcctggcaactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22711 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcagccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22712 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22713 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgtcttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcacgtggtacggaaactacctcaacaaaccgctaggacggacggtgatgctaaccgttcagttcacgctcggctggccttagtacgtag

SEQ ID NO: 22714 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22715 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcagcaacccgctaggacgcacggtgatgctaaccgtccagttcacgctcggctggcctttgtacttag

SEQ ID NO: 22716 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22717 - DNA, 335 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacagcccgctaggacgcacggtgatgctaaccgtccagttcacgctcggctggcctttgtacttag

SEQ ID NO: 22718 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22719 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22720 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22721 - DNA, 314 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaaaacccgctaggacgcacggtgatgctaaccgtccagttcacgctcggctggcctttgtacttag

SEQ ID NO: 22722 - DNA, 359 bp, Artificial
  Mutation in BnaC.FAD2.b introduced by TALE nuclease pair BnFAD2_T02
cctctcctccctcaccctctcccttacctcgcctggcccctctactgggcctgacagggctgcgtcctaaccggcgtctgggtcatagcgcacgagtgcggccaccacgccttcagcgactaccagtggctggacgacaccgtcggcctcatcttccactccttcctcctcgtcccttacttctcctggaaacagtcatcgacgccaccattccaacaccggatccctcgagagggatgaagtgttcgtccccaagaagaaatccgacatcaagtggttcggaaagttcctcagcatcccgcgagtacgcacggtgatcctaaccctcccgcccacgctcggctggcctttgtacttag

SEQ ID NO: 22723 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagccatcgacgccaccattccaacaccggatccctcgagagggacgaagtgttcgtccccaagaagaaatccgacatcgagtggtacggaaagtacctcaacaaccgtctaggacgcacggtgatgctaaccgtccagttcacgctcggctggcctttgtacttag

SEQ ID NO: 22724 - DNA, 355 bp, Artificial
  Mutation in BnaC.FAD2.b introduced by TALE nuclease pair BnFAD2_T02
cctctcctccctcaccctctctcctacttcgcctggcatctctactgagcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22725 - DNA, 352 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagatgaaatccgacatcaagtggtacggaaagtacctcaacaacccgctaggacgcacggtgatgctaaccgtccaggtcacgctcggctggcctttgtacttag

SEQ ID NO: 22726 - DNA, 348 bp, Artificial
  Mutation in BnaC.FAD2.b introduced by TALE nuclease pair BnFAD2_T02
cctctcctccctcaccctctcccttacctcgcctggcccctctgctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22727 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22728 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaatgttccagattacgctatcgatatcgccggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22729 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactgtctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22730 - DNA, 351 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22731 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacacgctaggacgcacggtgatgctaaccgtccagttcacgctcggctggcatgtgtacttag

SEQ ID NO: 22732 - DNA, 350 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 22733 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22734 - DNA, 335 bp, Artificial
  Mutation in BnaC.FAD2.b introduced by TALE nuclease pair BnFAD2_T02
cctctcctcctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22735 - DNA, 321 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22736 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22737 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaacgttccagttcacgctcggctggcctttgtacttag

SEQ ID NO: 22738 - DNA, 359 bp, Artificial
  Mutation in BnaC.FAD2.b introduced by TALE nuclease pair BnFAD2_T02
cctctcctccctcaccctctcccttacctcgcctgtcccctctactgggcctgccaaggctgcgtcctaacgggcctctgggtcatcgcccacgaatgctgccaccactccttcagcgaccaccagtgtctggactacgccgttggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccggtaggacgcacggtgatgctaaccgtccagttcacgctcggctggcctttgtacttag

SEQ ID NO: 22739 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaattaccgcaacagcccgctgggacgcacggtgaggctaaccgtccagttcacgctcggctggcctttgtacttag

SEQ ID NO: 22740 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccattgtacttag

SEQ ID NO: 22741 - DNA, 356 bp, Artificial
  Mutation in BnaC.FAD2.b introduced by TALE nuclease pair BnFAD2_T02
cctctcctccctcaccctctctcctacttcgcctggcccctctactgggactgccaaggctgcgtcctcacgggcctctgggtcatcgcccacgaatgcggccaccacgccttcagcgaccaccagtggctggacgacgccgtgcgcctcgtcttccactccttcctcctcgtcccttacttctcctggaagccatcgacgccaccattccaacaccggatccctcgagagggatgaagtgttcgtccccaagaagaaatcccacatcaagtggtccctaaagtacctcaacacgccgcaaggacgcacggtgatgctaaccgtccagttcccgctcggctggcctttgtacttag

SEQ ID NO: 22742 - DNA, 407 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttctccagcggctgttgccgccatcgtggctggcgatggccaccacctgagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22743 - DNA, 357 bp, Artificial
  Mutation in BnaC.FAD2.b introduced by TALE nuclease pair BnFAD2_T02
cctctcctccctcaccctctcccttacctcgcctggcccctctactcggcctgccaagtctgcgtcctaacgtgcctctgggtcatctcccacgaatgcggccaccactccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22744 - DNA, 343 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcgaccaccacgccttcagcgactaccagtggcttgacgacaccgtcggtctcatcttccactccttcctcctcgtcccttactatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22745 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22746 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 22747 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22748 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22749 - DNA, 407 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttctccagcggctgttgccgccatcgtggctggcgatggccaccacctgagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22750 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaaccagctaggatgcacggtgatgcttaccgtccagttcacgctcggctggcctttgtacttag

SEQ ID NO: 22751 - DNA, 356 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22752 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtctaccactccttcctcctcgtcttccatcgacgccaccattccaacaccggatccctcgagagggatgaagtgttcgtccccaagaagaaatccgccatcaagtggtacggaaagtacttctacaaaccgctaggaagcacggtgatgctaaccttccatttcacgctcggctggcctgtgtacttag

SEQ ID NO: 22753 - DNA, 354 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcatcccttacttctcctggaacatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22754 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22755 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgcagtgggcctcgtcttccactccttcctcctcgtcccttacttctcctggaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22756 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22757 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22758 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22759 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 22760 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22761 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccactaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacctag

SEQ ID NO: 22762 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctgaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22763 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22764 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22765 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22766 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22767 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22768 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22769 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22770 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 22771 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22772 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 22773 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgccctaaccggcgtctgggtcatagcccacgagtgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgttgctaaccgtccagttcacgctcggctggcctttgtacttag

SEQ ID NO: 22774 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 22775 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22776 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22777 - DNA, 383 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgagcctctgggtcatcgcccacgaatgcggccaccacgccttcagcgaccaccagtggctggacgacgccgtgggcctcgtcctgagtaggacaaatccgccgggagcggatttgaacgttgtgaagcaacggcccggagggtggcgggcgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22778 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcccaacgggcctctgggtcatcgcccacgaatgcggccaccacgccttcagcgaccaccagtggctggacgacaccgtgggcctcgtcttccactccttcctcctcgtcccttacttctcctggaaagccatcgacgccaccactccaacaccggatccctcgagagagatgaagtgttcgtccccaagaaggagtccgacatcaagtggtacggaaagtacctcaacaacccgctaggacgcacggtgatgctaaccgtccagttcacgctcggctggcctttgtacttag

SEQ ID NO: 22779 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaaccttccagtgcacgctcggctggcatttgtacttag

SEQ ID NO: 22780 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctagcgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22781 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22782 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacagcccgctaggacgcacggtgatgctaaccgtccagttcacgctcggctggcctttgtacttag

SEQ ID NO: 22783 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtgactggacgacgccgtgggcctcgtcttccactccttcctcctcgtcccttacttctcctggaacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22784 - DNA, 359 bp, Artificial
  Mutation in BnaC.FAD2.b introduced by TALE nuclease pair BnFAD2_T02
cctctcctccctcaccctctctcctacttcgcctggcccctctactgggcccgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22785 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22786 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaagccgctaggacgcacggtgatgctaaccgtccagttcacgctcggctggcctttgtacttag

SEQ ID NO: 22787 - DNA, 417 bp, Artificial
  Mutation in BnaC.FAD2.b introduced by TALE nuclease pair BnFAD2_T02
cctctcctccctcaccctctcccttacctcgcctggccccactactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattgttgccggtgctgtgccaggcccacggcttgaccccggagcaggtggtggccatcgccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22788 - DNA, 274 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22789 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 22790 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22791 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagtcatcgacgccaccattccaacaccggatccctcgagagggatgaagtgttcgtccccaagaagaaagccgacatcaagtggtacgggaagtacctcaacaacccgctaggacgcacggtgatgctatccgtccagttcactctcggctggcctttgtacttag

SEQ ID NO: 22792 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22793 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 22794 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22795 - DNA, 413 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcgaccaccacgccttcagcgactaccagtggctggacgacaccgtcggcctcatcttccactccttcctcctcgtcccttacttctcctggacaggcccacggcttgaccccccagcaggtggtggccatcgccagcaatggcggtggcagccatcgacgccaccattccaacaccggatccctcgagagggatgaagtgttcgtccccaagaagaaatccgacatcaagtggtacggaaagtacctcaacaacccgctaggacgcacggtgatgctaaccttccatttcacgctcggctggcctttgtacttag

SEQ ID NO: 22796 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22797 - DNA, 388 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcaataatggtggcaagcaggcgctggatccaagaagaaatccaccattccaacactggctccctcgagagggatgaagtgttcgtccccaagaagaaatccgacatcaagtggtacggaaagtacctcaacaacccgctaggacgcacggtgatgctaacggtccagttcacgctcggctggcctttgtacttag

SEQ ID NO: 22798 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22799 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22800 - DNA, 411 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacagagcgaggtatgtaggcggtgctacagagttcttgaagtggtggcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22801 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaaatgttcgtccccaagaagaaatccgacatcaagtggtacggaaagtacctcaacaacccgctaggacgcacggtgatgctaaccttccagttcactctcggctggcctttgtacttag

SEQ ID NO: 22802 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 22803 - DNA, 357 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgagcctctgggtcatcgcccacgaatgcggccaccccgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatcccacatcaagtggtacggaaagtacctcaacaacccgctaggacgcacggtgatgctaaccctccagttcacgctcggctggcctttgtacttag

SEQ ID NO: 22804 - DNA, 387 bp, Artificial
  Mutation in BnaC.FAD2.b introduced by TALE nuclease pair BnFAD2_T02
cctctcctccctcaccctctcccttacctcgcctcgcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgggcctggcacagcaccggcaacagccgctggacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22805 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22806 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtaccgcaacaacccgctaggacgcacggtgatgctaaccgtccagttcacgctcggctggcctttgtacttag

SEQ ID NO: 22807 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22808 - DNA, 356 bp, Artificial
  Mutation in BnaC.FAD2.b introduced by TALE nuclease pair BnFAD2_T02
cctctcctccctcaccctctctcctacttcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctggaacgcacggtgatgctaacggtgcagttcacgctcggctggccagtgtacttag

SEQ ID NO: 22809 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctggatcatagcccacgagtgcggccaccacgccttcagcgactaccagtggcttgacgacaccgtcggtctcatcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22810 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22811 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22812 - DNA, 356 bp, Artificial
  Mutation in BnaC.FAD2.b introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccgtcctcctcgtcccttacttctcctggaaatcattgacgccaccattccaacaccggatccctcgagagggatgaagtgttcgtccccaagaagaaagccgacatcaagtggtacggaaagtaccgcaacaacccactaagacgcacggtgatgctaaccggccagttgacgccctgctggcatatgggcctag

SEQ ID NO: 22813 - DNA, 450 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtacggtcgggctgaacggggggttcgtgcacacagcccagcttggagcgaacgaccttgacggatggccttctgcttagtttgatgcctggcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22814 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 22815 - DNA, 363 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagttatcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22816 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22817 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccagggctgcgtcctaaccggcctctgggtcatcgcccacgaatgcggccaccacgccttcagcgaccaccagtggctggacgacgccgtgggcctcgtcttccactccttcctcctcgtcccttacttctcctggaactcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22818 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22819 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 22820 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22821 - DNA, 359 bp, Artificial
  Mutation in BnaC.FAD2.b introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22822 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggactcatcgacgccaccattccaacaccagatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22823 - DNA, 411 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagtacagagcgaggtatgtaggcggtgctacagagttcttgaagtggtggcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22824 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22825 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22826 - DNA, 412 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacaacgccgtgggcctcgtcttccactccttcctcctcgtcccttacttctcctggaagtacaccttccaccactcgttggggttgatggagacggtccagcggctgttgccgagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22827 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22828 - DNA, 356 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaactggcctctgggtcatcgcccacgaatgcggccaccacgacttcaccgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctgtgggacgcaccgtgatgttaacgtttcagttcactctcggctggccttagtacttag

SEQ ID NO: 22829 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggtcaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 22830 - DNA, 351 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctagtacgcacggtgatgctaaccgtccagttcactctcggctggcctttgtacttag

SEQ ID NO: 22831 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22832 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcttccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 22833 - DNA, 356 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaacccgacatcaagtggtacggaaagtacctcaacaaccctctaggacgcacggtgatgctaaccgtccagttcacgctcggctggcctttgtacttag

SEQ ID NO: 22834 - DNA, 336 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22835 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtccaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22836 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22837 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccctcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22838 - DNA, 354 bp, Artificial
  Mutation in BnaC.FAD2.b introduced by TALE nuclease pair BnFAD2_T02
cctctctccctcaccctctcccttacctcgcctggcccctctactgggcctaccaaggctgcgtcctaacgggcctctgggtcatcgcccacgaatgcggccaccacgccttcagcgaccaccagtggctggacgacgccgttggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22839 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtggctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22840 - DNA, 356 bp, Artificial
  Mutation in BnaC.FAD2.b introduced by TALE nuclease pair BnFAD2_T02
cctctcctccctcaccctctaccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22841 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagtcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22842 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctcatcgacgccaccattccaacaccggatccctcgagagggatgaagtgttcgtccccaagaagaaatccgacatcaagtggtacggaaagtacctcaacaacccgctaggacgcagggtgatgctaaccgtccagttcacgctcccctggccttagtacttag

SEQ ID NO: 22843 - DNA, 322 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgtggtacttag

SEQ ID NO: 22844 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22845 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccgccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22846 - DNA, 386 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagcaatattggtggcaagcaggcgctgtcgggttatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22847 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22848 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22849 - DNA, 318 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22850 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22851 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22852 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22853 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 22854 - DNA, 353 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcgcggtgatgctatccgtccagttctcgctcggttggccgttgtacttag

SEQ ID NO: 22855 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 22856 - DNA, 360 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22857 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgatgtgttcgtccccaagaagaaatccgacatcaagtggtacggaaagtacctcaacaaccctttgggacgcaccgtgatgttaacggttcagttcactctcggctggcctttgtacttag

SEQ ID NO: 22858 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22859 - DNA, 379 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcgttcggctgcggcgagcggtacagtcatcgacgccaccattccaacactggctcccccgagagagacgaagtgttcgtccccaagaagaaatccgacatcaagttgtacggaaagtacctcaacaacccgctaggacgcacggtgatgctaaccgtccagttcacgctcggctggcctttgtacttag

SEQ ID NO: 22860 - DNA, 342 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctggcacagcaccggcaacagccgctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22861 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 22862 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22863 - DNA, 359 bp, Artificial
  Mutation in BnaC.FAD2.b introduced by TALE nuclease pair BnFAD2_T02
cctctcctccctcaccctctctccaacttcgcctggcctctctactgggcctgccaagggtgcgtcctaaccggcgtctgggtcatagcccacgagtgcggccaccacgccttcagcgactaccagtggctggacgacaccgtcggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22864 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 22865 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22866 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtaccgcaacaacccgctaggacgcacggtgatgctaaccgtccagttcacgctcggctggcctttgtacttag

SEQ ID NO: 22867 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatacgacatcaagtggtacggaaagtacctcaacaacccgctaggacgcacggtgatgctaaccgtccagttcacgctcggctggcctttgtacttag

SEQ ID NO: 22868 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatcccacatcaagtggtacggaaagtacctcaacaacccgctaggacgcacggtgatgctaaccgtccagttcacgctcggctggcctttgtacttag

SEQ ID NO: 22869 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcccggctggcctttgtacttag

SEQ ID NO: 22870 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22871 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22872 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22873 - DNA, 312 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22874 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgtccttggtacttag

SEQ ID NO: 22875 - DNA, 411 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtacagagcgaggtatgtaggcggtgctacagagttcttgaagtggtggcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22876 - DNA, 356 bp, Artificial
  Mutation in BnaC.FAD2.b introduced by TALE nuclease pair BnFAD2_T02
cctctcctccctcaccctctcccttacctcggctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22877 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22878 - DNA, 333 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgagcctctgggtcatcgcccacgaatgcggccaccacgccttcagcaaccaccagtggctggacgacgccgtgggcctcgtcttccactccttcctcctcatcgacgccaccattccaacaccggatccctcgagagggatgaagtgttcgtccccaagaagaagtcagacatcaagtggtacggcaaggacctcaacatcccttgggtacgcgcggtgatgttaacggttcagttcactctcggctgccctgtgtacttag

SEQ ID NO: 22879 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtattag

SEQ ID NO: 22880 - DNA, 345 bp, Artificial
  Mutation in BnaC.FAD2.b introduced by TALE nuclease pair BnFAD2_T02
cctctcctccctcaccctctcccttacctcgcctggcccctctactgggcttgccaaggctgcgtcctaacgggcctcttggtcatcgcccacgaatgcggccaccacgccttcagcgaccaccagtggctggacgacgccgtgggcctcgtcttccactccttcctcctcgtcccttacttctcctacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22881 - DNA, 360 bp, Artificial
  Mutation in BnaC.FAD2.b introduced by TALE nuclease pair BnFAD2_T02
cctctcctccctcaccctctcccttacctcgcctggcaccactactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacacagccatcgacgccaccattccaacaccggatccctcgagagggatgaagtgttcgtccccaagaagaaatccgacatcaagtgatacggaaagtacctcaacaacccgctaggacgcacggtgatgctaaccgtccagttcactctcggctttccttggtacttag

SEQ ID NO: 22882 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22883 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtggctccatcgacgccaccattccaacaccggatccctcgagagggatgaagtgttcgtccccaagaagaaatccgacatcaagtggtacggaaagtacctcaacaacccgctaggacgcacggtgatgcttaccgtccagttcacgctcggctggcctttgtacttag

SEQ ID NO: 22884 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctcgtacttag

SEQ ID NO: 22885 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22886 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22887 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 22888 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22889 - DNA, 315 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22890 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22891 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22892 - DNA, 352 bp, Artificial
  Mutation in BnaC.FAD2.b introduced by TALE nuclease pair BnFAD2_T02
cctctcctccctcaccctctcccttacctcgcctggcacctctactgggcctgacaaggctgcgtcctaacgggcctctgggtcatcgcccacgaatgcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22893 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22894 - DNA, 348 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtacttag

SEQ ID NO: 22895 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggatggacgacgccgtgggcctcgtcttccactccttcctcctcgtcccttacttctcccatcgacgccaccattccaacactggctccctcgagagggatgaagtgttcgtccccaagaagaaaaccgacatcaagtggtacggaaagtacctcaacaacccgctaggacgcaccgggatgttaccggttcagttcactctcggctggcctttgtacttag

SEQ ID NO: 22896 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22897 - DNA, 389 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22898 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22899 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22900 - DNA, 412 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcacagcaccggcaacagccgctggaccaggaaccgtaaaaaggccgcgttgcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22901 - DNA, 326 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22902 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcaccgtgatgttaacggttcagttcactctcggctggcctttgtacttag

SEQ ID NO: 22903 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22904 - DNA, 343 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctgaacgacgccgtgggcctcgtcttccactccttcctcctcgtccctacttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22905 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22906 - DNA, 350 bp, Artificial
  Mutation in BnaC.FAD2.b introduced by TALE nuclease pair BnFAD2_T02
cctctcctcactcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22907 - DNA, 389 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtatggtggccatcgccagcaatggcggtgacagtcatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 22908 - DNA, 390 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaatgttccagattacgctatcgatatcgccggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtattag

SEQ ID NO: 22909 - DNA, 411 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacagagcgaggtatgtaggcggtgctacagagttcttgaagtggtggcctacagccatcgacgccaccattccaacaccggatccctcgagagggatgaagtgttcgtccccaagaagaaatccgacatcaagtggtacggaaagtacctcagcaagccgctaggacgcacggtgaggctaaccgtccagttcacgctcggctggcctttgtacttag

SEQ ID NO: 22910 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22911 - DNA, 360 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagccatcgacgccaccattccaacaccggatccctcgagagggatgaagtgttcgtccccaagaagaaatccgacatcaagtggtacggaaagtacctcaacaacccgctaggacgcacggtgatgctaaccgcccagttcacgctcggctggcctttgtacttag

SEQ ID NO: 22912 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22913 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttatccatgacgccaccattccaacaccggatccctcgatagggacgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 22914 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22915 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22916 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcgcccaccacgccttcagcgaccaccagtggctggacgacgccgtgggcctcgtcttccactccttcctcctcgtcccttacttctcctgcatcgacgccaccattccaacactggctccctcgagagggatgaagtgttcgtccccaagaagaaatccgacatcaagtggtacggaaagtacctcaacaacccgctagtacgcacggtgatgctaaccttccacttcacgctcggctggcctttgtacttag

SEQ ID NO: 22917 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 22918 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22919 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 22920 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcactgtgatgctaaccgtccagttcacgctcggctggcctttgtacttag

SEQ ID NO: 22921 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22922 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22923 - DNA, 354 bp, Artificial
  Mutation in BnaC.FAD2.b introduced by TALE nuclease pair BnFAD2_T02
cctctcctccctcaccctctccctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22924 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactta

SEQ ID NO: 22925 - DNA, 336 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22926 - DNA, 356 bp, Artificial
  Mutation in BnaC.FAD2.b introduced by TALE nuclease pair BnFAD2_T02
cctctcctccctcaccctctctcctacttcgcctggcctctctcctgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaataagaaatccgacatcaagtggtacggaaaggacctcaacaacccgctaggacgcacggtgatgctaaccgtccagttcacgctcggctggcctttgtacttag

SEQ ID NO: 22927 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggagccatcgacgccaccattccaacaccggatccctcgagagggatgaagtgttcgtccccaagaagaaatccgacatcaagtggtacggcaagtacctcaacaaccctttgtgacgcacggtgatgctaaccttccagttcacgctcggctggcctttgtacttag

SEQ ID NO: 22928 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22929 - DNA, 349 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttccgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22930 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 22931 - DNA, 355 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcataacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22932 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaaccctctaggacgcacggtgatgctaaccgtccagttcacgctcggctggcctttgtacttag

SEQ ID NO: 22933 - DNA, 333 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22934 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22935 - DNA, 365 bp, Artificial
  Mutation in BnaC.FAD2.b introduced by TALE nuclease pair BnFAD2_T02
cctctcctccctcaccctctcccttacctcgcctgtcccctctactgggcctgcccagggtgcgtcctaaccggcctctgggtcctcgcccacgaatgcggccaccacgccttcagcgaccaccagtggctggacgaagccctcggcctcgtcttccactccttcctcctcgtcccttacttctcctggatgtacaaacagtcatcgacgccaccattccaacactggctccctcgagagagacgaagtgtttgtccccaagaagaagtcagacatcaagtggtacgggaagtacctcagcaaccctctaggacgcaccgtgatgctaacggtccagttcacgctcggctggcctttgtacttag

SEQ ID NO: 22936 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22937 - DNA, 362 bp, Artificial
  Mutation in BnaC.FAD2.b introduced by TALE nuclease pair BnFAD2_T02
cctctcctccctcaccatctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22938 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgtgtcatcgcccacgaatgcggccaccacgccatcgacgccaccattccaacaccggatccctcgagagggatgaagtgtttgtccccaagaagaagtcagacatcaagtggtacggcaagtacctcaacaacccttttggacgcaccgtgatgttaacggttcagttcactctcggctggcctttgtacttag

SEQ ID NO: 22939 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22940 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22941 - DNA, 394 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22942 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22943 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccattgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 22944 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaaccgtccagttcactctcggctggcctttgtacttag

SEQ ID NO: 22945 - DNA, 335 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgctgccaccacgccttcagcgactaccagtggctggacgacaccgtcggcctcatcttccactccttcctcctcgtcccttactcaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 22946 - DNA, 318 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 22947 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22948 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22949 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaaaccgacatcaagtggtacggaaagtacctcaacaacccgctaggacgcacggtgatgctaacggttcagttcactctcggctggcctttgtacttag

SEQ ID NO: 22950 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcaataatggtggcaagcaggcgctggatccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22951 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22952 - DNA, 358 bp, Artificial
  Mutation in BnaC.FAD2.b introduced by TALE nuclease pair BnFAD2_T02
cctctctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22953 - DNA, 362 bp, Artificial
  Mutation in BnaC.FAD2.b introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacaccggatccctcgagagggatgaagtgttcgtccccaagaagaaatccgacatcaagtggtacggaaagttcctcagcaacccgctaggacgcacggtgattctaaccctccagttcacgctcggctggcctttgtacttac

SEQ ID NO: 22954 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22955 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22956 - DNA, 359 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22957 - DNA, 392 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatgttctttcctgcgttatcccctgattctgtggatatcgacgccaccattccaacaccggatccctcgagagggatgaagtgttcgtccccaagaagaaatccgacatcaagtggtacggaagtacctcaacaacccgctaggacgcacggtgatgctaaccgtccagttcacgctcggctggcctttgtacttag

SEQ ID NO: 22958 - DNA, 326 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggtctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22959 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22960 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22961 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22962 - DNA, 274 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccattccaacaccggatccctcgagagggatggagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22963 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22964 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagagccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 22965 - DNA, 311 bp, Artificial
  Mutation in BnaC.FAD2.b introduced by TALE nuclease pair BnFAD2_T02
cctctcctccctcaccctctcccttacctcgcctggcccctctactgggcttgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgtctttgtccccaagaagaagtcagacatcaagtggtacggaaagtacctcaacaacccgctaggacgcacggtgatgctaaccgtccagttcacgctcggctggcctttgtacttag

SEQ ID NO: 22966 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaattacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22967 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtgttacggaaagtacctcaacaacccgctaggacgcacggtgatgctaaccgtccagttcacgctcggctggcctttgtacttag

SEQ ID NO: 22968 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaaggacctcaacaaccctttgggacgcaccgtgatgttaacggttcatttctcgctcgggtggcctgtatacttag

SEQ ID NO: 22969 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgatgttccagattacgctatcgatatcgccggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22970 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcaccgaccaccagtggttggacgacgccgtgggcctcgtcttccactccctcccccccgtcccttacttctcctggaagtcagccatcgacgccaccattccaacaccggatccctcgagagggatgaagtgttcgtccccaagaagaaatccgacatcaagtagtccggaaagtacctcaacaacccgctagaacgcacagtgatgctaaccgtgcagttcacgcgcggctggcatgagtacttag

SEQ ID NO: 22971 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22972 - DNA, 470 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccagcaataatggtggcaagcaggcgctggagacggtccagcggctgttgccggtgctgtgccaggcccacggcttgaccccccagcaggtggtggccatcgccagcaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22973 - DNA, 333 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22974 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtgacaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22975 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22976 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggctggcctttgtacttag

SEQ ID NO: 22977 - DNA, 362 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatcaggcatcacgtggtacggcaagtacctcaacagcccttcgggacgcaccgtgatgttaacggttcagttcactctcggctggcctttgtacttag

SEQ ID NO: 22978 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctagaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22979 - DNA, 358 bp, Artificial
  Mutation in BnaC.FAD2.b introduced by TALE nuclease pair BnFAD2_T02
cctctcctccctcaccctctcccttacctcggctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22980 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 22981 - DNA, 356 bp, Artificial
  Mutation in BnaC.FAD2.b introduced by TALE nuclease pair BnFAD2_T02
cctctcctccctcaccctctcccttacctcgcctagcccctctactgggcctgccaaggctgcgtcctaacgggcctctgggtcatcgcccacgaatgcggccaccacgccttcagcgaccaccagtggctggacgacgctgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22982 - DNA, 291 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccattctaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22983 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22984 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcgtcttccactccttcctcctcgtcccttacttctcctacagccatcgacgccaccattccaacaccggatccctcgagagggatgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 22985 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22986 - DNA, 339 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22987 - DNA, 433 bp, Artificial
  Mutation in BnaC.FAD2.b introduced by TALE nuclease pair BnFAD2_T02
cctctcctccctcaccctctcccttacctcgcctggcccctctactgggcctaccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcggcgagcggtatcagctcactcaaaggcggtaatacggttatccacagaatcaggggataacgcaggaaagaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22988 - DNA, 455 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgacggtccagcgcctgcttgccggtgctgtgccaggcccacggcttgaccccccagcaggtggtggccatcgccagcaatggcggtggcaagcaggcgctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22989 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctcacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22990 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttctttcacagccatcgacgccaccattccaacaccggatccctcgagagggatgaagtgttcgtccccaagaagaaatgcgacatcaagtggtacggaaagtacctcaccaacccgctaggacgcacggtgatgctaaccgtccagttcacgctcggctggcctttgtacttag

SEQ ID NO: 22991 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagtgatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22992 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22993 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22994 - DNA, 356 bp, Artificial
  Mutation in BnaC.FAD2.b introduced by TALE nuclease pair BnFAD2_T02
ccctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcatcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 22995 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 22996 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagggatgaagtgttcgtccccaagaagaaatccgacatcaagtggtatggaaagtacctcaacaacccgctaggacgcacggtgatgctaaccgtccagttcacgctcggctgcctttgtacttag

SEQ ID NO: 22997 - DNA, 359 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 22998 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 22999 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccttccagttcacgctcggctggcctttgtacttag

SEQ ID NO: 23000 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctagaaggccatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 23001 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23002 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccctcggtctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23003 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatgccatcgacgccgccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23004 - DNA, 345 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtcacatcttccactccttcctcctcgtcccttacttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23005 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 23006 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggctggacgacaccgtgggcctcgtcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23007 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatcaagtggtacggcaagtacctcaacacccctttgggacgcaccgtgatgttaaccgtccagttcacgctcggctggcctttgtacttag

SEQ ID NO: 23008 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23009 - DNA, 291 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23010 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 23011 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacgacccgctaggacgcaaggtgatgctaaccgtccagttcacgctcggctggcctttgtacttag

SEQ ID NO: 23012 - DNA, 388 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtggcagttccctactctcgcgttcgaatacagccatcgacgccaccattccaacaccggatccctcgagagggatgaagtgttcgtccccaagaagaaatccgacatcaagtggtacggaaagtacctcaacaacccgctaggacgcatggtgatgctaaccgtccagttcacgctcggctggcctttgtacttag

SEQ ID NO: 23013 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23014 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctagggcgcacggtgatgctaaccgtccagttcacgctcggctggcctttgtacttag

SEQ ID NO: 23015 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagctaccaccagtggctggacgacgccgtgggcctcgtcttccactccttcctcctcgtcccttacttctcctggatcgacgccaccactccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23016 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtcccaaagaagaaatccgacatcaagtggtacggaaagtacatcaacaacccgctaggacgcacggtgatgctaaccgtccagttcacgctcggctggcctttgtacttag

SEQ ID NO: 23017 - DNA, 356 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctcacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23018 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgagtgcggccaccacgccttcagcgactaccagtggcttgacgacaccgtcggcctcatcttccactccttcctcctcgtcccttacttctcctggagtcatcgacgccaccattccaacaccggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23019 - DNA, 346 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23020 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23021 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcgccttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23022 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23023 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgatgccaccattccaacaccggatccctcgagagggatgaagtgttcgtccccaagaagaaatccgacatcaagtggtacggaaagtacctcaacaacccgctaggacgcacggtgatgctaaacgtccagttcacgctcggctggcctgtgtacttag

SEQ ID NO: 23024 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggtctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtactta

SEQ ID NO: 23025 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23026 - DNA, 352 bp, Artificial
  Mutation in BnaC.FAD2.b introduced by TALE nuclease pair BnFAD2_T02
cctctcctccatcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23027 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtggctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23028 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 23029 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgttggcctcgtcttccactccttcctcctcgtcccttacttctcctggaacacagccatcgacgccaccattccaacaccggatccctcgagagggatgaagtgtttgtccccaagaagaaatccgacatcaagtggtacggaaagtacctcaacaacccgctaggacgcgcggggatgctaaccgtccagttcacgctcggctggcctttgtacttag

SEQ ID NO: 23030 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaagctgcgtcctaacgtgcctctgggtcatcgcccacgaatgctgccaccacgccttcagcgaccaccagtggctggacgacgccgtgggcctcgtcttccactccttcctcctcgtcccttacttctcctggatcgacgcctccattccaacaccggatccctcgagagggatgaagtgttcgtccccaagaagaagtcagacatcgagtggtacggcaagtacctcaacaaccctttgggacgcaccgtgatgttaacggtgcaggtcactctcggctggccgtggtacttag

SEQ ID NO: 23031 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23032 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtgcagttcacgctcggctggcctttgtacttag

SEQ ID NO: 23033 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23034 - DNA, 365 bp, Artificial
  Mutation in BnaC.FAD2.b introduced by TALE nuclease pair BnFAD2_T02
cctctcctccatcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23035 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgttaaccgtccagttcacgctcggctggcctttgtacttag

SEQ ID NO: 23036 - DNA, 344 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23037 - DNA, 359 bp, Artificial
  Mutation in BnaC.FAD2.b introduced by TALE nuclease pair BnFAD2_T02
cctctcctccctcaccctctctcctacttcgcctggcccctctactgggcctgtcaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23038 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23039 - DNA, 355 bp, Artificial
  Mutation in BnaC.FAD2.b introduced by TALE nuclease pair BnFAD2_T02
cctctctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23040 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggcttgcctttgtacttag

SEQ ID NO: 23041 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 23042 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23043 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtgcttag

SEQ ID NO: 23044 - DNA, 324 bp, Artificial
  Mutation in BnaC.FAD2.b introduced by TALE nuclease pair BnFAD2_T02
cctctcctccctcaccctctcccttacctcgcctggcccctctactgggccttccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23045 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagacaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23046 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23047 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcactctcggctggcctttgtacttag

SEQ ID NO: 23048 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtctaccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23049 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagcaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtcttag

SEQ ID NO: 23050 - DNA, 356 bp, Artificial
  Mutation in BnaC.FAD2.b introduced by TALE nuclease pair BnFAD2_T02
cctctcctccctcaccctctcccttacctcgcctggcctctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23051 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23052 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagctaccaccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 23053 - DNA, 364 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgcccccattccaacaccggatccctcgagagggatgaagtgttcgtccccaagaagaaatccgacatcaagtggtacggaaagtaactcaacaacccgctaggacgcacggggatgctaaccgtccagttcacgctcggctgggctttgtacttagc

SEQ ID NO: 23054 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaaacatcgacgccaccattccaacactggctccctcgagagagacgaagtgttcgtccccaagaagaaatccgacatcaagtggtacggaaagtacctcaacgacccgctaggacgcacggtgatgctaaccgtccagttcacgctcggctggcctttgtacttag

SEQ ID NO: 23055 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23056 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23057 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 23058 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23059 - DNA, 402 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgaccattacttctcaagccgtgggcctggcacagcaccggcaacagccgctggaccgtctcctacagccatcgacgccaccattccaacaccggatccctcgagagggatgaagtgttcgtccccaagaagaaatcctacatcaagtggtacggaaagtacctcaacaacccgctaggacgcacggtgatgctaaccgtccagttcacgctcggctggcctttgtacttag

SEQ ID NO: 23060 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaaatccgacatcgagtggtacggaaagtacctcaacaacccgctaggacgcccggtgatgctaaccgtccagttcacgctcggctggcctttgtacttag

SEQ ID NO: 23061 - DNA, 363 bp, Artificial
  Mutation in BnaC.FAD2.b introduced by TALE nuclease pair BnFAD2_T02
cctctcctccctcaccctatcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgcctccattccaacaccggatccctcgagagggatgaagtgttcgtccccaagaagaaaccccacatcgagtggtacggaaagtacctcagcaacccgctaggacgcacggtgatgctaaccgcacagttcccgctcggctggcctttgtacctag

SEQ ID NO: 23062 - DNA, 434 bp, Artificial
  Mutation in BnaC.FAD2.b introduced by TALE nuclease pair BnFAD2_T02
cctctctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttggacacaggccaacttctcaagattgcaaaacgtggcggcgtgaccgcagtggaggcagtgcatgcatggcgtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23063 - DNA, 355 bp, Artificial
  Mutation in BnaC.FAD2.b introduced by TALE nuclease pair BnFAD2_T02
cctctcctccctaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgcccagttcacgctcggctggcctttgtacttg

SEQ ID NO: 23064 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23065 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23066 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgggcctggcacagcaccggcaacagccgctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23067 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgccgccgtgtgcctcgtcttccactccttcctcctcgtcccttacttctcctggaacgccaccattccaacaccggatccctcgagagggatgaagcgttcgtccccaagaagaaatccgacatcaagtggtacggaaagtacctcaacaacccgctaggacgcacggtgaggctaaccggccgggtcacgctcggctggcctttgtgcttag

SEQ ID NO: 23068 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaacacagccatcgacgccaccattccaacaccggatccctcgagagggatgaagtgttcgtccccaagaagaaatccgacatcaagtggtacggaaagtacctcaacaccccgctaggacgcacggtgatgctaaccgtccagttcacgctcggctggcctttgtacttag

SEQ ID NO: 23069 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23070 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatcctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23071 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacgtag

SEQ ID NO: 23072 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacaccggatccctcgagagggatgaagtgttcgtccccaagaagaaatccgacatcaagtggtacggaaagtacctcaacacccctttgggacgcaccgtgttgttatcggttcagttcactctcggctggcttttgtacttag

SEQ ID NO: 23073 - DNA, 273 bp, Artificial
  Mutation in BnaC.FAD2.b introduced by TALE nuclease pair BnFAD2_T02
cctctcctcctcaccctctcccttacctcgcctggcccctctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23074 - DNA, 335 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23075 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23076 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactcattcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23077 - DNA, 274 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgtgtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23078 - DNA, 352 bp, Artificial
  Mutation in BnaC.FAD2.b introduced by TALE nuclease pair BnFAD2_T02
cctctcctccctcaccctctcccttacctcgcctggcccatctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23079 - DNA, 315 bp, Artificial
  Mutation in BnaC.FAD2.b introduced by TALE nuclease pair BnFAD2_T02
cctctcctccctcaccctctcccttacctcgcctggccccgctactgggcctgccaaggctgcgccctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatcctaaccgtccagttcacgctcggctggcctttgtacttag

SEQ ID NO: 23080 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23081 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23082 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttcaactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23083 - DNA, 324 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23084 - DNA, 354 bp, Artificial
  Mutation in BnaC.FAD2.b introduced by TALE nuclease pair BnFAD2_T02
cctctcctccctcacccccccttacctcgcctgtcccctctactgcgcctgccaatgctgcggcctaacgggcctctgggtcatcgcccacgaatgcgtccaccacgccttcatcgaccaccagtgtctgaacgacgccttgggcctcgtcttccactccttcctcctcctcccttacttctcctggaagccatcgacgccaccattccaacaccggatccctcgagagtgatgaagtgttcgtccccaagaagaaatcccacatcacctggttcggaaagtacctcaacatccgtttgggacgcaccgtgatgttaaccgctcagttcactctcggctggcctttgtacttag

SEQ ID NO: 23085 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgttcagttcacgctcggctggcctttgtacttag

SEQ ID NO: 23086 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23087 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23088 - DNA, 274 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 23089 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaaatccgacatcaagtggtacggtaagtacctcaacaacccgctaggacgcacggtgatgctaaccgtccagttcacgctcggctggcctttgtacttag

SEQ ID NO: 23090 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23091 - DNA, 324 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtgcagttcacgctcggctggcctttgtacttag

SEQ ID NO: 23092 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23093 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23094 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23095 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctcctggacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23096 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23097 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcacacgagtgcggccaccacgccttcagcgactaccagtggctggacgacaccgtcggcctcatcttccactccttcctcctcgtcccttacttctcctggaacagccatcgacgccaccattccaacaccggatccctcgagagggatgaagtgttcgtccccaagaagaaatccgacataaagtggtacggaaagtacctcaacaacccgctaggacgcacggtgatgctaaccgtccagttcacgctcggctggcctttgtacttag

SEQ ID NO: 23098 - DNA, 408 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgctgccaccacgccttcagcgaccaccagtggctggacgacgccgtgggcctcgtcttccactccttcctcctcgtcccttacttctcctggaagcctttcgttttaattgatgcctggcagttccctattctcgtgttgaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23099 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcgcacgaatgcggccaccacgccttcagcgaccaccagtggctggacgacgccgtgggcctcgtcttccactccttcctcctcgtcccttacttctcctggatgccatcgacgccaccattccaacaccggatccctcgagagggatgaagtgttcgtccccaagaagaaatccgacatcaagtcctccctaatctacgtcagcatcagacgaggacaagcggcggcccttacccccccgtccacgctcggctggcctttgtacttag

SEQ ID NO: 23100 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctccggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23101 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23102 - DNA, 411 bp, Artificial
  Mutation in BnaC.FAD2.b introduced by TALE nuclease pair BnFAD2_T02
cctctctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctgaaccacatcaccaactgcaacggcgccgtgctgtccgtggaggagctccagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23103 - DNA, 411 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgaccccgtgggcctcgtcttccactccttcctcctcgtcccttacttctcctggaagtacagagcgaggtatgtaggcggtgctacagagttcttgaagtggtggcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23104 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23105 - DNA, 393 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatgttctttcctgcgttatcccctgattctgtggatatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23106 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcgactggcctttgtacttag

SEQ ID NO: 23107 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacgacccactaggacgcacggtgatgctaaccgtccagttcacgctcggctggcctttgtacttag

SEQ ID NO: 23108 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcacgtggtacggaaagtacctcaacaacccgctaggacgcacggtgatgctaaccgtccagttcacgcccggctggcctttgtacttag

SEQ ID NO: 23109 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcatttgtacttag

SEQ ID NO: 23110 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttcctcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 23111 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcttgcctttgtacttag

SEQ ID NO: 23112 - DNA, 339 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgctgccaccacgccttcagcgactaccaggggctggacgacaccgtcggcctcatcttccactccttcctcctcgtcccttacgacgccaccattccaacaccggatccctcgagagggatgaagtgttcgtccccaagaagaaatccgacatcaagtggtccggaaagtacctctacaacccgctaggacgcacggtgatgctaaccgtgcagttcacgctcggctggcctttgtacttag

SEQ ID NO: 23113 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23114 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaaccatcgacgccaccattccaacaccggatccctcgagagggatgaagtgttcgtccccaagaagaaatccgacatcgagtggtacggaaagtacctcaacaacccgctaggacgcacggtgatgctaaccgtccagttcacgctcggctggcctttgtacttag

SEQ ID NO: 23115 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttaacgctcggctggcctttgtacttag

SEQ ID NO: 23116 - DNA, 356 bp, Artificial
  Mutation in BnaC.FAD2.b introduced by TALE nuclease pair BnFAD2_T02
cctctcctccctcaccctctcccttacctcgcctgacccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23117 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23118 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23119 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccattacttctcctggaagtcagccatcgacgccaccagtccaacaccggatccctcgagagggatgaagtgttcgtccccaagaagaaatccgacatcaagtggtacggaaagtacctcaacaacccgctaggacgcacggtgatgctaaccggccagttcactctcggctggccgttgtacttag

SEQ ID NO: 23120 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcataacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgaggctaaccgacaagtccacgcccggcgggcctttgtacttag

SEQ ID NO: 23121 - DNA, 348 bp, Artificial
  Mutation in BnaC.FAD2.b introduced by TALE nuclease pair BnFAD2_T02
cctctcctccctcaccctctcccttaccacgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23122 - DNA, 413 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggacaggcccacggcttgaccccccagcaggtggtggtcatcgccagcaatggcggtggcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23123 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctagtacgcacggtgatgctaaccgtccagttcacgctcggctggcctttgtacttag

SEQ ID NO: 23124 - DNA, 336 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23125 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctgaccgtccagttcacgctcggctggcctttgtacttag

SEQ ID NO: 23126 - DNA, 358 bp, Artificial
  Mutation in BnaC.FAD2.b introduced by TALE nuclease pair BnFAD2_T02
cctctcctccctcacactctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 23127 - DNA, 422 bp, Artificial
  Mutation in BnaC.FAD2.b introduced by TALE nuclease pair BnFAD2_T02
cctctctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagttaggccaccacttcaagaactctgtagcaccgcctacatacctcgctctgctaatcctgttagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23128 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23129 - DNA, 347 bp, Artificial
  Mutation in BnaC.FAD2.b introduced by TALE nuclease pair BnFAD2_T02
cctctcctccctcaccctctcccttacctcgcctggcccctctactgggcctgcaaaggctgtgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23130 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatctgacatcaagtggtacggaaagtacctcaacaacccgctaggacgcacggtgatgctaaccgtccagttcactctcggctggcctttgtacttag

SEQ ID NO: 23131 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcatttgtacgtag

SEQ ID NO: 23132 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcgaccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23133 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23134 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaaatccgacatcaagtggtacggaaagtacctcaacaccccgctaggacgcacggtgatgctaaccgtccagttcacgctcggctggcctttgtacttag

SEQ ID NO: 23135 - DNA, 357 bp, Artificial
  Mutation in BnaC.FAD2.b introduced by TALE nuclease pair BnFAD2_T02
cctctcctccctcaccctctctcctacttctcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggcaccgaaagtcccccaacacgccggaaggacgtaaggtgaagctaatcctccagctcacgctcggctggcctttgtacttag

SEQ ID NO: 23136 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23137 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 23138 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtgcagttcacgcgcggctggcctttgtacttag

SEQ ID NO: 23139 - DNA, 337 bp, Artificial
  Mutation in BnaC.FAD2.b introduced by TALE nuclease pair BnFAD2_T02
cctctcctccctcaccttctctcctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23140 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23141 - DNA, 330 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23142 - DNA, 402 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23143 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtgcagttcacgctcggctggcctttgtacttag

SEQ ID NO: 23144 - DNA, 355 bp, Artificial
  Mutation in BnaC.FAD2.b introduced by TALE nuclease pair BnFAD2_T02
cctctcctccctcaccctctctcctacttctcctggcttctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggagtcatcgacgccaccattccaacaccggatccctcgagagggatgaagtgttcgtccccaataagaaatccgacatcaagtggtacggaaagtacctcaacaacccgctaggacgcacggtgatgctaaccgtccagttcacgctcggctggcctttgtacttag

SEQ ID NO: 23145 - DNA, 356 bp, Artificial
  Mutation in BnaC.FAD2.b introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23146 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatcactcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23147 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 23148 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacgggaagtacctcaacaacccgctaggacgcacggtgatgctaaccgtccagttcacgctcggctggcctttgtacttag

SEQ ID NO: 23149 - DNA, 345 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23150 - DNA, 357 bp, Artificial
  Mutation in BnaC.FAD2.b introduced by TALE nuclease pair BnFAD2_T02
cctctcctccctcaccctctcccttacctcgtctgccccccctactgggcctgccaacgctgcgtcctaacgggcctctgggtcatcgcccacgaatgcgtccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtcgtacggcaagtcccccaacacgccgctagtatacacggtactgctacccctcccgctcccgctcggctggcctttgtacttag

SEQ ID NO: 23151 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23152 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23153 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggcaaccacgccttcagcgactaccagtggcttgacgacaccgtcggtctcatcttccactccttcctcctcgtcccttacttctcctggaaatcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23154 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23155 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacgtag

SEQ ID NO: 23156 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23157 - DNA, 356 bp, Artificial
  Mutation in BnaC.FAD2.b introduced by TALE nuclease pair BnFAD2_T02
cctctcctccctcaccctctcccttacctcgcctggcccctctactaggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23158 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacagtgtcggtctcatcttccactccttcctcctcgtcccttacttctcctggatcgacgccaccattccaacactggctccctcgagagagacgaagtgtttgtccccaagaagaaagccgacatcaagtggtacgaaaagtacctcaacaacccgctggaacgcacagtgatgctaaccgtgcagttcacgctcggctagcatttgtacttag

SEQ ID NO: 23159 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctccttgtcccttacttctcctggaacatcgacgccaccattccaacaccggatccctcgagagggatgaagtgttcgtccccaagaagaaatccgacatcaagtggtacggaaagtacctcaacaccccgctaggacgcacggtgatgctaaccgtccagttcacgctcggctggcctttgtacttag

SEQ ID NO: 23160 - DNA, 357 bp, Artificial
  Mutation in BnaC.FAD2.b introduced by TALE nuclease pair BnFAD2_T02
cctctcctccctcaccctctcccttacctcgcctgtcccctctactgggcctgccaaggctgcgtcctaacgggcctctgggtcatcgccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgaggctaaccgtgcagttcacgctcggctggcctttgtacttag

SEQ ID NO: 23161 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23162 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23163 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23164 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23165 - DNA, 358 bp, Artificial
  Mutation in BnaC.FAD2.b introduced by TALE nuclease pair BnFAD2_T02
cctctcctccctcaccctctctcctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23166 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatccggccaccacgccttcagcgaccaccagtggctggacgacgtcctgggcctcgtcttccactccttcctcctcgtcccttacttctcctggaatcgacgccaccattccaacaccggatccctcgagagggatgaagtgttcgtccccaagaagaaatccgacatcacgtgttccggcaagtacctcaacaaccctttgggacgcaccgtgaggttaacggatcgggtcactctcggctggcctttgtacttag

SEQ ID NO: 23167 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcttgcctttgtacttag

SEQ ID NO: 23168 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23169 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgaatgcggccaccacgccttcagcgaccaccagtggctggacgacgccgtgggcctcgtcttccactccttcctactcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23170 - DNA, 470 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgatcatctcgccgccgatcaggagctcctccacggacagcacggcgccgtgccaggcccacggcttgaccccccagcaggtggtggccatcgccagcaataatggtggcacagccatcgacgccaccattccaacaccggatacctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 23171 - DNA, 357 bp, Artificial
  Mutation in BnaC.FAD2.b introduced by TALE nuclease pair BnFAD2_T02
cctctcctccctcaccctctcccttacctcgcctggcccctctacttggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23172 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcgaccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23173 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23174 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 23175 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtgcttag

SEQ ID NO: 23176 - DNA, 353 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttaattctcctggacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23177 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23178 - DNA, 354 bp, Artificial
  Mutation in BnaC.FAD2.b introduced by TALE nuclease pair BnFAD2_T02
cctctcctccctcaccctctcccttacctctcctgtcccctctactgggcctgccaagtctgcgtcctaacgggcctctgggtcatcgcccacgaatgcggccaccacgccttcagcgaccaccagtggctggacgacgccgtgggcctcgtcttccactccttcctcctcgtcccttacttctcctggaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23179 - DNA, 356 bp, Artificial
  Mutation in BnaC.FAD2.b introduced by TALE nuclease pair BnFAD2_T02
cctctcctccctcaccctctctcctacttcgcctggcctctctactgcgcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23180 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 23181 - DNA, 339 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttcgtattag

SEQ ID NO: 23182 - DNA, 402 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaaatccgacatcaagtggtacggaaagtacctcaacaacccgctaggacgcccggtgatgctaaccgtccagttcacgctcggctggcctttgtacttag

SEQ ID NO: 23183 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctggcacagcaccggcaacagccgctggaccgtctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23184 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23185 - DNA, 354 bp, Artificial
  Mutation in BnaC.FAD2.b introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctagaacgcacggtgatgctaaccgtccagttcacgctcggctggcctttgtacttag

SEQ ID NO: 23186 - DNA, 369 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagccaccaatattgctggcgatggccaccattccaacaccggatccctcgagagggatgaagtgttcgtccccaagaagaaatccgacatcaagtggtacggaaagtatctcaacaacccgctaggacgcacggtgatgctaaccgtccagttcacgctcggctggcctttgtacttag

SEQ ID NO: 23187 - DNA, 348 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtacttag

SEQ ID NO: 23188 - DNA, 355 bp, Artificial
  Mutation in BnaC.FAD2.b introduced by TALE nuclease pair BnFAD2_T02
cctctcctccctcaccctatccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttgaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23189 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacaccggatccctcgagagggatgaagtgttcgtccccaagaagaaatccgacatcaagtggtacggaaagtacctcaacaccccgctaggacgcacggtgatgctaaccgtccagttccctctcggctggcctttgtacttag

SEQ ID NO: 23190 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 23191 - DNA, 315 bp, Artificial
  Mutation in BnaC.FAD2.b introduced by TALE nuclease pair BnFAD2_T02
cctctcctccctcaccctctctcctacttcgcctggcctctatactgggcctgccagggctgcgtcctaaccggcgtctgggtcatagcccacgagtgcggccaccacgccttcagcgactaccagtggctggacgacaccgtcggcctcatcatcgacgccaccattccaacaccggatccctcgagagggatgaagtgttcgtccccaagaagaaatccgacatcaagtggtacggaaagtacctcaacaacccgctaggacgcacggtgatgctaaccttccagttcacactcggctggcctttgtacttag

SEQ ID NO: 23192 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23193 - DNA, 310 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23194 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggatcgacgccaccattccaacaccggttccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23195 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23196 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgctgccaccacgccttcagcgactaccagtggctggacgacaccgtcggcctcatcttccactccttcctcctcgtcccttacttctcctggaagtatacagtcatcgacgccaccattccaacactggctccctcgagagggatgaagtgttcgtccccaagaagaaatccgacatcaagtggtacggaaagtacctcaacagcccgctaggacggacggtgatgctaaccgtccagttcgcgctcggctggccgttgtacgtag

SEQ ID NO: 23197 - DNA, 353 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaagtcagacatcaagtggtacggcaagtacctcaacaaccctttgggactcaccgtgaggttaacggttcagtgcagtctcggctggcctttgtacttag

SEQ ID NO: 23198 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattcaaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23199 - DNA, 453 bp, Artificial
  Mutation in BnaC.FAD2.b introduced by TALE nuclease pair BnFAD2_T02
cctctcctccctcaccctctcccttacctcgcctggcccctctactggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtctccagcgcctgcttgccgccatcatatcactgtgtggcttcaggccgccatccactgcggagccgtacaaatgtacggccagcaacgtcggttcgagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23200 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgaggctaaccgcccagttcacgctcggctggcctttgtacttag

SEQ ID NO: 23201 - DNA, 393 bp, Artificial
  Mutation in BnaC.FAD2.b introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagagacgaagtgtttgtacccaagatgaaatccgacatcaagtggtacggaaagtacatcaacaacccgctaggacgcacggtgatgctacccgtccagttcacgctcggctggcatttgtacttag

SEQ ID NO: 23202 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23203 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23204 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23205 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcctctgggtcatcgcccacgaatgcggccaccacgccttcagcgactaccagtggctggacgacaccgtcggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23206 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgccctgtgatgctaaccgtccagttcacgctcggctggcctttgtacttag

SEQ ID NO: 23207 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23208 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23209 - DNA, 423 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagttaggccaccacttcaagaactctgtagcaccgcctacatacctcgctctgctaatcctgttagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23210 - DNA, 359 bp, Artificial
  Mutation in BnaC.FAD2.b introduced by TALE nuclease pair BnFAD2_T02
cctctcctccctcaccctctctactacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23211 - DNA, 323 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 23212 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgtttgtccccaagaagaagtcagacatcaagtggtacggcaagtacctcaacaacccgctaggacgcacggtgatgttaaccgttcagttcactctcggctggcctttgtacttag

SEQ ID NO: 23213 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacaccggatccctcgagagggatgaagtgttcgtccccaagaagaaatccgacatcaagtggtacggaaagtacctcagcagcccgcgaggaggcgcggtgaggcgaaccgtgcagttcacgcgcggctggcctttgtacttag

SEQ ID NO: 23214 - DNA, 332 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctggcacagcaccggcaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcaagctcggctggcctttgtacttag

SEQ ID NO: 23215 - DNA, 365 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttcctcctcgtcccttacttctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23216 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacgccgtgggcctcgtcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23217 - DNA, 340 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaacgggcctctgggtcatcgcccacgaatgcggccaccacgccttcagcgaccaccagtggctggacgacgccgtgggcctcgtcttccactccttcttcctcgtcttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcatttgtacttag

SEQ ID NO: 23218 - DNA, 392 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggtctcatcttccactccttcctcctcgtcccttacttctcctggagactgagcctttcgttttatctgttgtttgtcggtgaacgctcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23219 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23220 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacactggctccctcgagagggatgaagtgttcgtccccaagaagaaatccgacatcaagtggtacggaaagtacctcaacaacccgctaggacgcacggtgaggctaaccgtccagttcacgctcggcgggcctttgtacttag

SEQ ID NO: 23221 - DNA, 274 bp, Artificial
  Mutation in BnaC.FAD2.b introduced by TALE nuclease pair BnFAD2_T02
cctctcctccctcaccctctcccttacctcacctggcccctctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23222 - DNA, 412 bp, Artificial
  Mutation in BnaC.FAD2.b introduced by TALE nuclease pair BnFAD2_T02
cctctcctccctcaccctctcgcttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcacagcaccggcaacagccgctggaccaggaaccgtaaaaaggccgcgttgcagccatcgacgccaccattccaacaccggatccctcgagagagatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23223 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtacagttcacgctcggctggcctttgtacttag

SEQ ID NO: 23224 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23225 - DNA, 362 bp, Artificial
  Mutation in BnaC.FAD2.b introduced by TALE nuclease pair BnFAD2_T02
cctctactccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccattacttctcctggaaagtacagcgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23226 - DNA, 337 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcttccacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23227 - DNA, 347 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 23228 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23229 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23230 - DNA, 355 bp, Artificial
  Mutation in BnaC.FAD2.b introduced by TALE nuclease pair BnFAD2_T02
cctcttctccctcaccctgtcccttacctcgcctggcccctctactcggcctgccaaggctgcgtcctaacgggcctttgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgagggtaaccgtccaggtcacgctcggcgggcctttgtacttag

SEQ ID NO: 23231 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggccggcctttgtacttag

SEQ ID NO: 23232 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23233 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtcccaaagaagaaatccgacatcaagtggtacggaaagtacctcaacaacccgctaggacgcacggtgatgctaaccgtccagttcacgctcggctggcctttgtacttag

SEQ ID NO: 23234 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtcctgttcacgctcggctggcctttgtacttag

SEQ ID NO: 23235 - DNA, 351 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaccccgctagaacgcacggtgatgctaaccgtccaggtcacgctcggctggcatttgtacttag

SEQ ID NO: 23236 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaactcatcgacgccaccattccaaaactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 23237 - DNA, 324 bp, Artificial
  Mutation in BnaC.FAD2.b introduced by TALE nuclease pair BnFAD2_T02
cctctcctccctcaccctctctcctactccgcctggcctctctactgggcctgccagggctgcgtcctaaccggcgtctgggtcatagcccacgagtgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23238 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23239 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23240 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcatcgacgccaccattccaacaccggatccctcgagagggatgaagtgttcgtccccaagaagaaatccgacatcaagtggtacggaaattacctcaacaacccgctaggacgcacggtgatgctaaccgtccagttcacgctcggctggcctttgtacttag

SEQ ID NO: 23241 - DNA, 450 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacggtcgggctgaacggggggttcgtgcacacagcccagcttggagcgaacgaccttgacggatggccttctgcttagtttgatgcctggcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23242 - DNA, 337 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagctaccaccagtggctggacgacgccgtgggcctcgtcttccactccttcttccacagccatcgacgccaccattccaacaccggatccctcgagagggatgaagtgttcgtccccaagaagaaatccgacatcaagtggtacggaaagtacctcaacgacccgctagggcgcacggggatgcgaaccgtccagttcacgctcggctggcctttgtacttag

SEQ ID NO: 23243 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttaattctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23244 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctaggctggcctttgtacttag

SEQ ID NO: 23245 - DNA, 408 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccgtcgctgtcaagtatcaggacatgatcgcagcgttgccagaggcgacacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23246 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgcctccagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23247 - DNA, 358 bp, Artificial
  Mutation in BnaC.FAD2.b introduced by TALE nuclease pair BnFAD2_T02
cctctcctccctcaccctctcccttacctcgcctggcccctctactgggcctaccaaggctgcgtcctaacgggcctctgggtcatcgcccacgaatgcggccaccacgccttcagcgaccaccagtggctggacgacgccgcgggcctcgtcttccactccttcctcctcgtcccttacttctcctggaacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtactaag

SEQ ID NO: 23248 - DNA, 388 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtggcagttccctactctcgcgttcgaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23249 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcatggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23250 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23251 - DNA, 444 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcaggcctctgcagtcgacgggcccgggatccgatccaatgaccccccagcaggtggtggccatcgccagcaataatggtggcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggccgttgtacttag

SEQ ID NO: 23252 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 23253 - DNA, 350 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23254 - DNA, 350 bp, Artificial
  Mutation in BnaC.FAD2.b introduced by TALE nuclease pair BnFAD2_T02
cctcttctccctcaccctgtctcctacttcgccttgcctctctactcggcctgccaagggtgcgtcctaaccggcgtctgggtcatagcccacgagtgcggccaccacgccttcagcgaccaccagtggctggacgacaccgtcggtctcatcttccactcctttctcctcgtcccttactcctcctcatcgacgccaccattccaacaccggatccctcgagagggatgaagtgttcgtccccaagaagaaatccgacatcaagtggtacggaaagtacctcagcagcccgctaggacgcgcggtgaggctaaccgtccaggtcacgctcggctggcctttgtacttag

SEQ ID NO: 23255 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23256 - DNA, 340 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23257 - DNA, 350 bp, Artificial
  Mutation in BnaC.FAD2.b introduced by TALE nuclease pair BnFAD2_T02
cctctcctccctcaccctctcccttacctcgcctggcccctctactgtgcctgccaaggctgcgtcctcacgggcctctgggtcatcgcccacgaatgcggccaccacgccttcagcgactaccagtggctggacgacaccgtcggcctcatcttccactccttcctcctcgtcccttacttctagtcatcgacgccaccattccaacactggctccctcgagagggatgaagtgttcgtccccaagaagaaatccgacatcaagtggtacggaaagtccctcaacaccccgctaggacgcacggtaatgctacccgtccagttcactctcggctggcctttgtacttag

SEQ ID NO: 23258 - DNA, 362 bp, Artificial
  Mutation in BnaC.FAD2.b introduced by TALE nuclease pair BnFAD2_T02
cctctcctcctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgcctccattccaacaccggagccctcgagagggatgaagtgttcgtccccaagaagaaagccgacatcaagtggtacggaaagtacctcaacaacccgctaggacgcacggtgatgctaaccgtccagttcacgctcggctggcctttgtacttag

SEQ ID NO: 23259 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23260 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgttcgtccccaagaagaaatccgacaccaagtggtacggaaagtacctcaacaccccgctaggacgcacgaggttgctaaccgtccagtcctcgcttggctggcctttgtacttag

SEQ ID NO: 23261 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaagtcagacatcaagtggtacggcaagtacctcaacaaccgtttgggacgcaccttgatgttaacggttcatttcactctcggctggcctttgtacttag

SEQ ID NO: 23262 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatcccttgagagggatgaagtgttcgtccccaagaagaaacccgacatcaagtggcccctcaagtcccccaccacgccggtaggacgcacggtgctgctacccgtcccgttcccgctcggctggcctttgtacttag

SEQ ID NO: 23263 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23264 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23265 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgtgtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23266 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaagtcagacatcaagtggtacggcaagtacctgaacacccctttgggacgcaccgtgatgttaacggttcagttcactctcggctggcctttgtacttag

SEQ ID NO: 23267 - DNA, 363 bp, Artificial
  Mutation in BnaC.FAD2.b introduced by TALE nuclease pair BnFAD2_T02
cctctcctccctcaccctctcccttacctcgcctggcccctctactgagcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttaccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23268 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23269 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgttcagttcacgctcggctggcctttgtacttag

SEQ ID NO: 23270 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23271 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23272 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctagaacgcacggtgatgctaaccgtccagttcacgctcggctggcctttgtacttag

SEQ ID NO: 23273 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctatgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggccgttgtacttag

SEQ ID NO: 23274 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggccttgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23275 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcaggacgacgccgtgggcctcgtcttccactccttccgcctcgtcccttacttctcctggaaggagtcatcgacgccaccattccaacactggctccctcgagagagacgaagtgtttgtccccaagaagaaatccgacatcaagtggtacggaaagtacctcaacaacccgctaggacgcacggtgatgctaaccgtccagtgcacgctcggctggcctttgtacttag

SEQ ID NO: 23276 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 23277 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctatgggtcatcgcccacgaatgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23278 - DNA, 391 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaatgttccagattacgctatcgatatcgccggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23279 - DNA, 353 bp, Artificial
  Mutation in BnaC.FAD2.b introduced by TALE nuclease pair BnFAD2_T02
cctctcctccctcacccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23280 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23281 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23282 - DNA, 357 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggccgttgtacttag

SEQ ID NO: 23283 - DNA, 291 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23284 - DNA, 389 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23285 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtaccacaacaacccgctaggacgcacggtgatgctaaccgtccagttcacgctcggctggcctttgtacttag

SEQ ID NO: 23286 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatcgcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttgtacttag

SEQ ID NO: 23287 - DNA, 358 bp, Artificial
  Mutation in BnaC.FAD2.b introduced by TALE nuclease pair BnFAD2_T02
cctctcctccctcaccctctcccttacctcttctggcccctctactgggcctgccaaggctgcgtcctaacgggcctctgggtcatcgcccacgaatgtggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtccggcaagtaccccaacaaccctgtgggacacaacgggatgccacccctccagttccctctcggctggcctttgtacttag

SEQ ID NO: 23288 - DNA, 315 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23289 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 23290 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23291 - DNA, 412 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctgaaccacatcaccaactgcaacggcgccgtgctgtccgtggaggagctccagccatcgacgccaccattccaacaccggatccctcgagagggatgaagtgttcgtccccaagaagaaatccgacatcaagtggtacggaaagtacctcaacaacccgctaggacgcacggtgatgctaaccgttcagttcactctcggctggcctttgtacttag

SEQ ID NO: 23292 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtgcagttcacgctcggctggcctttgtacttag

SEQ ID NO: 23293 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23294 - DNA, 272 bp, Artificial
  Mutation in BnaC.FAD2.b introduced by TALE nuclease pair BnFAD2_T02
cctctccccctcaccctctcccttacctcgcctggcccctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23295 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatctacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23296 - DNA, 356 bp, Artificial
  Mutation in BnaC.FAD2.b introduced by TALE nuclease pair BnFAD2_T02
ccttcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23297 - DNA, 355 bp, Artificial
  Mutation in BnaC.FAD2.b introduced by TALE nuclease pair BnFAD2_T02
cctctcctccctcaccctctcccttacctcgtctgcctcccctactgggcctgccaaggctgcgccctaacggccctctgggtcatcgcccacgaatgcgtccaccacgccttcagcgaccaccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggaaagtacccgaacgccccagtaggacgcacggtacagccacccgtcccgttcccgctcggctggcctttgtacttag

SEQ ID NO: 23298 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaacgggcctctgggtcatagcccacgagtgcggccaccacgccttcagcgactaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23299 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23300 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23301 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgctgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23302 - DNA, 357 bp, Artificial
  Mutation in BnaC.FAD2.b introduced by TALE nuclease pair BnFAD2_T02
cctctcctccctcaccctctctcctacttcgcctggccactctactgggcctgccagggctgcgtcctaaccggcgtctgcgtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23303 - DNA, 274 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23304 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactta

SEQ ID NO: 23305 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgccaggacgcacggtgatgctaaccgtccagttcacgctcggctggcctttgtacttag

SEQ ID NO: 23306 - DNA, 358 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgtgagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23307 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23308 - DNA, 357 bp, Artificial
  Mutation in BnaC.FAD2.b introduced by TALE nuclease pair BnFAD2_T02
actctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23309 - DNA, 358 bp, Artificial
  Mutation in BnaC.FAD2.b introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23310 - DNA, 362 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtggctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23311 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcggctaccagtggctggacgacaccgtcggcctcatcttccactccttcctcctcgtcccttacttctcctggaagtgccatcgacgccaccagtccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23312 - DNA, 391 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgatgccgtgggcctcgtcttccactccttcctcctcgtcccttacttctcctggaagtacaatgttccagattacgctatcgatatcgccggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23313 - DNA, 409 bp, Artificial
  Mutation in BnaC.FAD2.b introduced by TALE nuclease pair BnFAD2_T02
cctctcctcctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctgaaccacatcaccaactgcaacggcgccgtgctgtccgtggaggagctccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttacttag

SEQ ID NO: 23314 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctttacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23315 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23316 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23317 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccgccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23318 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctatgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23319 - DNA, 435 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttggacacaggccaacttctcaagattgcaaaacgtggcggcgtgaccgcagtggaggcagtgcatgcagggcgtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23320 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23321 - DNA, 359 bp, Artificial
  Mutation in BnaC.FAD2.b introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23322 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23323 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 23324 - DNA, 355 bp, Artificial
  Mutation in BnaC.FAD2.b introduced by TALE nuclease pair BnFAD2_T02
cctctcctccccccccctctcccttacctcgcctggcccctctactcggcctcccccggctgcgtcctaacgggcctctgggtcatcgcccacgacttcggccaccacgccttcagcgaccaccagtggctggacgacgccctcttcctcgtcttccactccttcctcctcgtcccttacttctcctggaaccatcgacgccaccactccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23325 - DNA, 389 bp, Artificial
  Mutation in BnaC.FAD2.b introduced by TALE nuclease pair BnFAD2_T02
cctctcctccctcaccctctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctttgcctggcacagcaccggcaacagccgctggaccgtctccagctgtcatcgacgcaaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23326 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgcccccaagaagaaatccgacatcaagtggtacggcaagtacctcaacacccctttgggacgcaccgtgatgttatcggttcagttctctctcggctggcctttgtacttag

SEQ ID NO: 23327 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccattacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23328 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23329 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 23330 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23331 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23332 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23333 - DNA, 453 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctggtcatcgcccacgaatgcggccaccacgccttcagcgaccaccagtggctggacgacgccgtgggcctcgtcttccactccttcctcctcgtcccttacttctcctggagtctccagcgcctgcttgccgccatcatatcactgtgtggcttcaggccgccatccactgcggagccgtacaaatgtacggccagcaacgtcggttcgagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23334 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacaccggatccctcgagagggatgaagtgttcgtccccaagaagaagtcagacatcaagtggtacggcaagtacctcaacacccctttgggacgcaccgtgatgttatcggttcagttcactctcggctggcctttgtacttag

SEQ ID NO: 23335 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23336 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaacgtccagttcacgctcggctggcctttgtacttag

SEQ ID NO: 23337 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccactccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23338 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 23339 - DNA, 435 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagttggacacaggccaacttctcaagattgcaaaacgtggcggcgtgaccgcagtggaggcagtgcatgcatggcgtacagccatcgacgccaccattccaacaccggatccctcgagagggatgaagtgttcgtccccaagaagaaatccgacatcaagtggtacggaaagtacctcaacaaccctcgagtacgcacggtgatgctaaccgtccagttcacgctcggctggcctttgtacttag

SEQ ID NO: 23340 - DNA, 357 bp, Artificial
  Mutation in BnaC.FAD2.b introduced by TALE nuclease pair BnFAD2_T02
cctctcctccctcaccctctcccttacctcgcctggcccctctactgggcctgtcaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23341 - DNA, 384 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggactacgccgtgggcctcgtcttccactccttcctcctcgtcccttacttctcctgggcgctcggtcgttcggctgcggcgagcggagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23342 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23343 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcactgtgatgctaaccgtccagttcacgctcggctggcctttgtacttag

SEQ ID NO: 23344 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23345 - DNA, 274 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23346 - DNA, 405 bp, Artificial
  Mutation in BnaC.FAD2.b introduced by TALE nuclease pair BnFAD2_T02
cctctcctccctcaccctctcccttacctcgcctggccacactactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatgttgccaccgccattgctggcgatggccaccacctgctggggggtcaagccatcgacgccaccattccaacactggctccctcgagagagacgaagtgtttgtccccaagaagaaatccgacatcaagtggaacggaaactacctcaacgacccgctaggccgcgcgatgagtctatccgtccagtcctcgctcggctggcctttgtacttag

SEQ ID NO: 23347 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaaagtcatcgacgccaccattccaacaccggatccctcgagagggatgaagtgttcgtcaccaagaagaaatccgacatcaagtggtacggaaagtacctcaacaacccgctaggacgcacggtgatgctaaccgtccagttcacgctcggctggcctttgtacttag

SEQ ID NO: 23348 - DNA, 315 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23349 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 23350 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcccggtgatgctaaccgtccagttcacgctcggctggcctttgtacttag

SEQ ID NO: 23351 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcctctgggtcatcgcccacgaatgcggccaccacgccttcagcgaccaccagtggctggacgacgccgtgggcctcgtcttccactccttcctcctcgtcccttacttctcctggaacacagccatcgacgccaccattccaacaccggatccctcgagagggatgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23352 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 23353 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccacgacgccaccattccaacactggctccctcgagagagacgaagtgttcgtccccaagaagaaatccgacatcaagtggtacggaaagtacctcaacaacccgctaggactcacggtgatgctaaccgtccagttcacgctcggctggcctttgtacttag

SEQ ID NO: 23354 - DNA, 365 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23355 - DNA, 347 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23356 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23357 - DNA, 360 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23358 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactcattcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 23359 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 23360 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23361 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 23362 - DNA, 394 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctggtcccttacttctcctggaagtgccaccattatttctggcgatggccaccacctgctagccatcgacgccaccattccaacacgggatccctcgagagggatgaagtgttcgtccccaagaagaaatccgacatcaagtggtacggaaagtacctcagcaacccgctaggacgcacggtgaggctaaccgtccagttcacgctcggctggcctttgtacttag

SEQ ID NO: 23363 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23364 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23365 - DNA, 321 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctggcacagcacctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23366 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23367 - DNA, 352 bp, Artificial
  Mutation in BnaC.FAD2.b introduced by TALE nuclease pair BnFAD2_T02
cctctcctccctcaccctctcccttacctcggctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 23368 - DNA, 473 bp, Artificial
  Mutation in BnaC.FAD2.b introduced by TALE nuclease pair BnFAD2_T02
cctctactccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacgcgcacatcgttgcgttaagccaacacccggcagcgttagggaccgtcgctgtcaagtatcaggacatgatcgcagcgttgccagatgccaactttgtacaaaaaagcaggcagccatcgacgccaccattccaacaccggatccctcgagagggatgaagtgttcgtccccaagaagaaatccgacatcaagtggtacggaaagtacctcaacaacccgctagggcgcacggtgatgctaaccgtccagttcacgctcggctggcctttgtactg

SEQ ID NO: 23369 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23370 - DNA, 408 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccggtgctgtgccaggcccacggcttgaccccccagcaggtggtggccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23371 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtacttag

SEQ ID NO: 23372 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23373 - DNA, 344 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23374 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccaacatcaagtgatacggaaagtaccacaacatcccgctagagcgctcggtgatactaaccgtccagttcacgctcggctggcctttgtgcttag

SEQ ID NO: 23375 - DNA, 357 bp, Artificial
  Mutation in BnaC.FAD2.b introduced by TALE nuclease pair BnFAD2_T02
cctctcctcccaccctctctcctacttcgcctggcctctctacttggcctgccaagggtgcgtcctaacgggcctctgggtcatcgcccacgaatgcggccaccaccccttcagcgaccaccagtggctggacgaccccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgattctaaccgtccagttcacgctcggctggcctttgtacttag

SEQ ID NO: 23376 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23377 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggctccctcgagagagacgaagtgtttgtccccaagaagaagtcagacatcaagtggtacggcaagtacctcaacaacccgctgggacgcaccgtgatgttaacggttcagttcactctcggctggcctttgtacttag

SEQ ID NO: 23378 - DNA, 358 bp, Artificial
  Mutation in BnaC.FAD2.b introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23379 - DNA, 274 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgtggccaccacgccttcagcgaccaccattccaacaccggatccctcgagagggatgaagtgttcgtccccaagaagaagtcagacatcaagtggtacggcaagtacctcaacaaccctttgggacgcaccgtgatgttaacggttcagttcactctcggctgccctttgtacgtgg

SEQ ID NO: 23380 - DNA, 355 bp, Artificial
  Mutation in BnaC.FAD2.b introduced by TALE nuclease pair BnFAD2_T02
cctctcctccctcaccctctcccttacctcgcctggcccctctactgggcctgacaaggctgcgtcctaacgggcctctgggtcatcgcctacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaccccactaggacgcacggtgatgctaaccgtccattacactctcggctggcctttgtacttag

SEQ ID NO: 23381 - DNA, 357 bp, Artificial
  Mutation in BnaC.FAD2.b introduced by TALE nuclease pair BnFAD2_T02
cctctcctccctcaccctctcccctacttcgcctggcccctctactgggcctgccaagggtgcgtcctaaccggcgtctgggtcatagcccacgagtgcggccaccacgccttcagcgaccaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaaccctctaggacgcacggtgatgctaaccgtccagttcacgctcggctggcctttgtacttag

SEQ ID NO: 23382 - DNA, 354 bp, Artificial
  Mutation in BnaC.FAD2.b introduced by TALE nuclease pair BnFAD2_T02
cctctcctccctcaccctctctcctacttcacctggcctctctactgggcctgccagggctgcgtcccaaccggcgtctgggtcatcgcccacgaatgcggccaccacgccttcagcgaccaccagtggctggacgacgccgtgggcctcgtcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtactaag

SEQ ID NO: 23383 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23384 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttccccctcgtcccttacttctcctggaagtcatcgacgcccccattccaacactggctccctcgagagagacgaagtgtttctccccaagaagaagtcagacatcaagtggtacggaaagtacctcaagaacccgctggtacgcacggtgatgctaaccgtccagttcacgctcggctggcctttgtactag

SEQ ID NO: 23385 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23386 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcacgctcggctggcctttgtacttag

SEQ ID NO: 23387 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23388 - DNA, 393 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgacccttacttctcctggaagtacatgttctttcctgcgttatcccctgattctgtggatatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23389 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23390 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgtcctttgtacttag

SEQ ID NO: 23391 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23392 - DNA, 324 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 23393 - DNA, 343 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtccctacttatcgacgccaccattccaacaccggatccctctagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23394 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23395 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23396 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctcttggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23397 - DNA, 314 bp, Artificial
  Mutation in BnaC.FAD2.b introduced by TALE nuclease pair BnFAD2_T02
cctctcctcctcaccctctcccttacctcgcctggcccctctactgggcctgccaaggctgcgtcctaacgggcctctgggtcatcgcccacgaatgcggccaccacgccttcagcgaccaccagtggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23398 - DNA, 336 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23399 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggcgcgtcctaaccggcgtctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaataaatccgacatcaagtggtacggaaagtacctcaacaacccgctaggacgcacggtgatgctaaccgtccatttctcgctcggctggcctttgtacttag

SEQ ID NO: 23400 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaacggttcagttcactctcggctggcctttgtacttag

SEQ ID NO: 23401 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctgtactacaccgtcggcctcatcttccactccttcctcctcgtcccttacttctcctggaagtagtcatcgacgccaccattccaacactggctccctcgagagagacgaagtgtttgtccccaagaagaaatccgacatcaagtggtacggaaagtagcccaacaacccggtaggacgtacggtgatgctaaccctccagttcccgctcggctggcctttgtacttag

SEQ ID NO: 23402 - DNA, 357 bp, Artificial
  Mutation in BnaC.FAD2.b introduced by TALE nuclease pair BnFAD2_T02
cctctcctccctcaccctctcccttacctcgcctttcccctctactggtcctgccaaccctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctacccgtccagttcacgctcggctggcctttgtacttag

SEQ ID NO: 23403 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23404 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23405 - DNA, 363 bp, Artificial
  Mutation in BnaC.FAD2.b introduced by TALE nuclease pair BnFAD2_T02
cctcttctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaagccgacaccaagtggtacggaaagtccctcagcgaccgggtaggacgcgcggaggggctagcggtccaggtcgggctgggggggccttggtacgtgg

SEQ ID NO: 23406 - DNA, 362 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23407 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgaccaccagtggctggacgacgccgtgggcctcgtcttccactccttcctcctcgtcccttacaaagccatcgacaccaccattccaacaccggatccctcgagagggatgaagtgttcgtccccaagaagaaatccgacatcaagtggtacggaaagtacctcaacaacccgctaggacgcacggtgagtctaaccgtccagttcacgctcggctggcctttgtacttag

SEQ ID NO: 23408 - DNA, 362 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23409 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23410 - DNA, 355 bp, Artificial
  Mutation in BnaC.FAD2.b introduced by TALE nuclease pair BnFAD2_T02
cctctcctcctcaccctctctcctacttcgcctggcctctctactgggcctgccaagggtccgtcctaaccggcgtctgggtcatagcccacgagtgcggccaccacgccttcagcgactaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggcgggccgtggtacttag

SEQ ID NO: 23411 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 23412 - DNA, 357 bp, Artificial
  Mutation in BnaC.FAD2.b introduced by TALE nuclease pair BnFAD2_T02
cctctcctccctcacccctctatcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23413 - DNA, 408 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttctccagcgcctgcttgccgccatcgtggctggcgatggccaccacctgagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23414 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtccttag

SEQ ID NO: 23415 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23416 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggagccaccattccaacaccggatccctcgagagggatgaagtgttcgtccccaagaagaaatccgacatcaagtggtacggaaattacctcaacaacccgctaggacgcacggtgatgctacccttccagttcacgctcggctggcctttgtactta

SEQ ID NO: 23417 - DNA, 450 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgaccaccagtggctggacgacgccgtgggcctcgtcttccactccttcctcctcgtcccttacttctcctggaagtacggtcgggctgaacggggggttcgtgcacacagcccagcttggagcgaacgaccttgacggatggccttctgcttagtttgatgcctggcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23418 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaaccctttgggacgcaccgtgaggttaacggttcagttgactcgcggctggccttggtacttag

SEQ ID NO: 23419 - DNA, 357 bp, Artificial
  Mutation in BnaC.FAD2.b introduced by TALE nuclease pair BnFAD2_T02
cctctcctccctcaccctctctactacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23420 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23421 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctatccgtccagttcacgctcggctggcctttgtacttag

SEQ ID NO: 23422 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccatcgacgccaccattccaacaccggatccctcgagagggatgaagtgttcgtccccaagaagaaatcctacatcaagtggtacggaaagtacctcaacaacccgctaggacgcacggtgatgctaaccgtccagttcacgctcggctggcctttgtacttag

SEQ ID NO: 23423 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23424 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgatgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23425 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggcaagtacctcaacaacccttggggacgcaccgtgatgttaacggttcaggtcactctcggctggcctttgtacttag

SEQ ID NO: 23426 - DNA, 358 bp, Artificial
  Mutation in BnaC.FAD2.b introduced by TALE nuclease pair BnFAD2_T02
ccctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23427 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttttacttag

SEQ ID NO: 23428 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 23429 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcatcttccactccttcctcctcgtccctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23430 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 23431 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcagcaacccgctaggacgcacggtgattctaaccgtccagttcacgctcggctggcctttgtgcttag

SEQ ID NO: 23432 - DNA, 349 bp, Artificial
  Mutation in BnaC.FAD2.b introduced by TALE nuclease pair BnFAD2_T02
cctctcctccctcaccatctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23433 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacactggctccctcgagagagacgaagtgtttgtccccaagaagaagtcagacatcaagtggtacggaaagtacctcaacaacccgctagaacgcacggtgatgctaaccgtccaggtcacgctcggctggccttagtacttag

SEQ ID NO: 23434 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 23435 - DNA, 372 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcaagtcagaggtggcgaaacccgacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23436 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcctctgggtcatcgcccacgaatgcggccaccacgccttcagcgaccaccagtggctggacgacgccgtcggcctcgtcttccactccttcctcctcgtcccttacttctcctggaaagccatcgacgccaccattccaacaccggatccctcgagagagatgaagtgttcgtccccaagaagaaatccgacatcaagtggtacggcaagtacctcaacaacccgctgggacgcacggtgatgttaaccgttcagttcacgctcggctggcctttgtacttag

SEQ ID NO: 23437 - DNA, 412 bp, Artificial
  Mutation in BnaC.FAD2.b introduced by TALE nuclease pair BnFAD2_T02
cctctcctccctcaccctctcccttacctcgcctggcccctctacttggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctgaaccacatcaccaactgcaacggcgccgtgctgtccgtggaggagctccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23438 - DNA, 357 bp, Artificial
  Mutation in BnaC.FAD2.b introduced by TALE nuclease pair BnFAD2_T02
cctctcctccctcaccctctcccttacctcgcctcgctcctctactgggcctgccaaggctgcgtcctaacgggcctctgggtcatcgcccacgaatgcggcaaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacgggaagtagctcaacatcccgttggaacgcaccgtgatgttaacggttcagttgactctcggctggccttagtacttag

SEQ ID NO: 23439 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 23440 - DNA, 357 bp, Artificial
  Mutation in BnaC.FAD2.b introduced by TALE nuclease pair BnFAD2_T02
cctctcctccctcaccctctctcctacttcgcctggactctctactgggcctgccagggctgcgtcctaaccggcgtatgggtcatagcccacgagtgcggccaccacgccttcagcgactaccagtggctggacgacaccgtcggcctcctcttccactccttcctcctcgtcccttacttctcctggaaggccatcgacgccaccattccaacaccggatccctcgagagggatgaagtgttcgtccccaagaagaaatccgacatcaagtggtacggaaagtaccacagcgacccgcgaggacgggcggtggtgctaaccgtccagttcacgctcggctggccttagtacgtag

SEQ ID NO: 23441 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccttggtacttag

SEQ ID NO: 23442 - DNA, 355 bp, Artificial
  Mutation in BnaC.FAD2.b introduced by TALE nuclease pair BnFAD2_T02
cctctcctccctcaccctctcccttacctcgcctcgcccctctactgggcctgccaaggctgcgtcctaccgggcctctgggtcatcgcccacgaatgctcccactacgccttcagcgaccaccagtgcctggacgacgccctgggcctcgtcttccactccttcctcctcgtcccttacttctcctggagccatcgacgccaccattccaacaccggacccctcgagagggatgaagggttcgtccccaagaagaagccagacatcaagtggtacggcaattacctcaagaaccctttgggacgcaccgtgattttaacggttcagttgactcgcgcctggccttagtacgtag

SEQ ID NO: 23443 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23444 - DNA, 356 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23445 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23446 - DNA, 359 bp, Artificial
  Mutation in BnaC.FAD2.b introduced by TALE nuclease pair BnFAD2_T02
cctctactccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacgccggatccctcgagagggatgaagtgttcgtccccaagaagaaatccgacatcgagtggtgcggaaagtacctcaacaacccgctaggacggtcggtgatgctaggcgtccggttcacgctgggctggcctctatacttag

SEQ ID NO: 23447 - DNA, 359 bp, Artificial
  Mutation in BnaC.FAD2.b introduced by TALE nuclease pair BnFAD2_T02
cctctcctccctcaccctctcgcttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcagcaacccgcgaggacgcgcggtgatactaaccgcccaggtcgtgctcgtctgccctgtgtacttag

SEQ ID NO: 23448 - DNA, 353 bp, Artificial
  Mutation in BnaC.FAD2.b introduced by TALE nuclease pair BnFAD2_T02
cctctcctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagcaccgcaaccacccgctaggacgcacggtgaggctaaccgtccagttcacgcgcggctggccttagtacttag

SEQ ID NO: 23449 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23450 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctatccgtccagttcacgctcggctggcctttgtacttag

SEQ ID NO: 23451 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 23452 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatcccacctccagtggtacggaaagtacctcaacaacccgctaggacgcccggtgattctaaccgtccagttcccgctcggctggcctttttacttag

SEQ ID NO: 23453 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactcgcggctggcctttgtacttag

SEQ ID NO: 23454 - DNA, 357 bp, Artificial
  Mutation in BnaC.FAD2.b introduced by TALE nuclease pair BnFAD2_T02
cctctcctccctcaccctctcccttacctcgcctggcctctctactgggcctgccaagggtgcgccctaaccggcgtctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23455 - DNA, 324 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctgggacgcacggtgatgctaaccgtccatttcacgctcggctggccttagtacttag

SEQ ID NO: 23456 - DNA, 394 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtacctcaacaacccgctaggacgcacggtgaggctaaccttccagttcacgcgcggctggcctgagtacttag

SEQ ID NO: 23457 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 23458 - DNA, 291 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccttcagcgaccaccagtggctggacgacaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23459 - DNA, 315 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23460 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23461 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggaaagtacatcaacaacccgctaggacgcacggtgatgctaaccgtccagttcacgctcggctggcctttgtacttag

SEQ ID NO: 23462 - DNA, 310 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23463 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23464 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23465 - DNA, 365 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23466 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcccctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23467 - DNA, 394 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23468 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 23469 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23470 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 23471 - DNA, 365 bp, Artificial
  Mutation in BnaC.FAD2.b introduced by TALE nuclease pair BnFAD2_T02
cctctcctccctcaccctctcacttacctcgcctggcccctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaagtacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23472 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 23473 - DNA, 349 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23474 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23475 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23476 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgttaaccgtccagttcacgctcggctggcctttgtacttag

SEQ ID NO: 23477 - DNA, 455 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaccgtctccagcgcctgcttgccaccattattgctggcgatggccaccacctgctggggggtcaagccgtgggcctggcacagcaccggcaacagccgcttgtcatcgacgccaccatcccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23478 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttcccctccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23479 - DNA, 342 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23480 - DNA, 356 bp, Artificial
  Mutation in BnaC.FAD2.b introduced by TALE nuclease pair BnFAD2_T02
cctcttctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacgggaagtacctcaacaacccgctaggacgcacggtgaggctaaccgtccagttcacgctcggttggccttggtgcttag

SEQ ID NO: 23481 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23482 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagactaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23483 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23484 - DNA, 396 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaatcaatttgttgcaacgaacaggtcactatcagtcaaaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgatcggctggcctttgtacttag

SEQ ID NO: 23485 - DNA, 350 bp, Artificial
  Mutation in BnaC.FAD2.b introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccttcggcctcatcttccactccttcctcctcgtcccttacttctagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23486 - DNA, 393 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacgccgtgggcctcgtcttccactccttcctcctcgtcccttacttctcctggaagtacatgttctttcctgcgttttcccctgattctgtggatatcgacgccaccattccaacaccggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23487 - DNA, 351 bp, Artificial
  Mutation in BnaC.FAD2.b introduced by TALE nuclease pair BnFAD2_T02
cctcttctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 23488 - DNA, 361 bp, Artificial
  Mutation in BnaC.FAD2.b introduced by TALE nuclease pair BnFAD2_T02
cctctcctccctcccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23489 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtgggccttgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggccttagtacttag

SEQ ID NO: 23490 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctaggacgcaaggtgatgctaaccgtccagttcacgctcggctggcctttgtacttag

SEQ ID NO: 23491 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23492 - DNA, 312 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggcttaacgacaccgtcggtctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23493 - DNA, 363 bp, Artificial
  Mutation in BnaC.FAD2.b introduced by TALE nuclease pair BnFAD2_T02
cctctcctccctcaccctctctcctacttcgcctggcccctatactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23494 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtactag

SEQ ID NO: 23495 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23496 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtccattacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23497 - DNA, 357 bp, Artificial
  Mutation in BnaC.FAD2.b introduced by TALE nuclease pair BnFAD2_T02
cctctcctccctcaccctctcccttacctcgtctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23498 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23499 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 23500 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcagcaacccttttgtacgcaccgtgatgttaacggttcatttcactctcgcctggcctttgtacttag

SEQ ID NO: 23501 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagtgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23502 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacatctcctggaaagtggctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23503 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23504 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggatgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23505 - DNA, 421 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagttaggccaccacttcaagaactctgtagcaccgcctacatacctcgctctgctaatcctgttagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggccttgtactta

SEQ ID NO: 23506 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgatgttccagattacgctatcgatatcgccggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23507 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcttccatcgacgccaccattccaacaccggatccctcgagagggatgaagtgttcgtccccaagaagaaatccgacatcaagtggtacggaaagtacctcaacaacccgctaggacgcacggtgatgctaacggttcagttcactctcggctggcctgtgtacttag

SEQ ID NO: 23508 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23509 - DNA, 402 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23510 - DNA, 356 bp, Artificial
  Mutation in BnaC.FAD2.b introduced by TALE nuclease pair BnFAD2_T02
cctctcctccctcaccctctatcctacttcgcctggcctctctactgcgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacgttgatgctaaccgtccagttcacgctcggctggcctttgtacttag

SEQ ID NO: 23511 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23512 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggctccctcgtgagagacgaagtgtttgtccccaagaagaagtcagacatcaagtggtacggcaagtacctcaacaacccttttggacggagcgtgatgttaagggtacaggtcagtctcggctggcctctgtgcctag

SEQ ID NO: 23513 - DNA, 354 bp, Artificial
  Mutation in BnaC.FAD2.b introduced by TALE nuclease pair BnFAD2_T02
ccttcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggattcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23514 - DNA, 383 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgcgcctctgggtcatcgcccacgaatgcggccaccacgccttcagcgaccaccagtggctggacgacgccgtgggcctcgtcctgagtaggacaaatccgccgggagcggatttgaacgttgtgaagcaacggcccggagggtggtgggcgtcgacgccaccattccaacaccggatccctcgagagggatgaagtgttcgtccccaagaagaaatccgacatcaagtggtacggaaagtacctcaacaacccgctaggacgcacggtgatactaaccgttcagttcactctcggctggcctttgtacttag

SEQ ID NO: 23515 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtggtacggaaagtacctcaacaacccgctaggacgcacggtgatgctaaccgtcccgttcacgctcggctggcctttgtacttag

SEQ ID NO: 23516 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaaaagccatcgacgccaccattccaacaccggatccctcgagagggatgaagtgttcgtccccaagaagaaatccgacatcaagtggtacggaaagtacctcaacaacccgctaggacgcacgttgatgctaaccgtccagttcacgctcggctggcctttgtacttag

SEQ ID NO: 23517 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23518 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatcccccgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23519 - DNA, 321 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggccttacttag

SEQ ID NO: 23520 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23521 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23522 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23523 - DNA, 385 bp, Artificial
  Mutation in BnaC.FAD2.b introduced by TALE nuclease pair BnFAD2_T02
cctcttctccctcaccctctcccttacctcgcctggcccctctactgggcctgccaaggctgcgtcctaacgggcctctgggtcatcgcccacgagtgcggccaccacgccttcagcgaccaccagtggctggacgacgccgtgggcctcgtcttccactccttcctcctcgtcccttacttctcctcgtcttccactccttcctcctcttcccaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 23524 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23525 - DNA, 354 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaccatcgacgctaccattccaacaccggatccctcgagagggatgaagtgttcgtccccaagaagaaatccgacatcaagtggtacggaaagtacctcaacaacccgctaggacgcacggtgatgctatccgtccagttcacgctcggctggcctttatacttag

SEQ ID NO: 23526 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23527 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatgtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttagc

SEQ ID NO: 23528 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23529 - DNA, 358 bp, Artificial
  Mutation in BnaC.FAD2.b introduced by TALE nuclease pair BnFAD2_T02
cctctactccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23530 - DNA, 359 bp, Artificial
  Mutation in BnaC.FAD2.b introduced by TALE nuclease pair BnFAD2_T02
cctctactccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaaatccgacatcaagtggtacggaaagtacctcaacaacccgctatgacgcacggtgatgctaaccgtccagttcacgctcggctggcctttgtacttag

SEQ ID NO: 23531 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcgacgccaccattccaacaccggatccctcgagagggatgaagtgttcgtccccaagaagaaatccgacagcaagtggtacggaaagtacctcaacaacccgctaggacgcagggtgaggctaaccgtccagttcacgcgcggctggcctttgtacttag

SEQ ID NO: 23532 - DNA, 379 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttccactccttacttactcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23533 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23534 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23535 - DNA, 356 bp, Artificial
  Mutation in BnaC.FAD2.b introduced by TALE nuclease pair BnFAD2_T02
cctctcctccctcaccctctctcctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23536 - DNA, 273 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgcttaccgtccagttcacgctcggctggcctgtgtacttag

SEQ ID NO: 23537 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatacgacatcaagtggtacggaaagtacctcaacaacccgctaggacgcacggtgatgctaaccgtccagttcacgctcggctggcctttgtacttag

SEQ ID NO: 23538 - DNA, 414 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggagaccccccagcaggtggtggtcatcgccagcaataatggtggcaagcaggcgctggagagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23539 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23540 - DNA, 357 bp, Artificial
  Mutation in BnaC.FAD2.b introduced by TALE nuclease pair BnFAD2_T02
cctctcctccctcaccctctatcctacttcgcctggcctatctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23541 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactgactccctcgatagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23542 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctacagccatcgacgccaccattccaacaccggatccctcgagaaggattaagtgttcgtccccaagaagaaatccgacatcaagtggtacggaaagtacctcaacaacccgctaggacgcacggtgatgctaaccgtccagttcacgcgcggctggccttagtacttag

SEQ ID NO: 23543 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23544 - DNA, 356 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccaggtcacgcgcggctggccttagtacttag

SEQ ID NO: 23545 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaattacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23546 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23547 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcaccgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23548 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagtgcactctcggctggcctttgtacttag

SEQ ID NO: 23549 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23550 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttaag

SEQ ID NO: 23551 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23552 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaagactgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagtcatcgacgccaccattccaacactggctccctcgagagggatgaagtgttcgtccccaagaagaaattcgacatcaagtggtacggaaagtgcctcaacaacccgctaggacgcacggtgatgctagccgtccagttcacgctcggctggcctttgacttag

SEQ ID NO: 23553 - DNA, 383 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcctgagtaggacaaatccgccgggagcggatttgaacgttgtgaagcaacggcccggagggtggcgggcgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23554 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 23555 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctcttggtcatagcccacgagtgcggccaccacgccttcagcgactaccagtggcttgacgacaccgtcggtctcatcttccactccttcctcctcgtcccttgcttctcctggaagagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23556 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaagtcagacatcaagtggtacggcaagtacctcaacaaccctttgggacgcaccgggatgttaacggttcagttcactcgcggctggcctttgtacttag

SEQ ID NO: 23557 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtactgaaagtacctcaacaacccgctaggacgcacggtgatgctaaccgtccagttcacgctcggctggcctttgtacttag

SEQ ID NO: 23558 - DNA, 390 bp, Artificial
  Mutation in BnaC.FAD2.b introduced by TALE nuclease pair BnFAD2_T02
cctctcctccctcaccctctctcctacttcgcctggcctatctactgggcctgccaagggtgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggaaagtacctcaacaacccgctaggacgcccggtgattctaaccttccagttctcgctcggctggcctttgtactta

SEQ ID NO: 23559 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatgccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23560 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggcctcatcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23561 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgcgaggacgcacggttttgctaaccgtccagttcacgctcggctggcctttgtacttag

SEQ ID NO: 23562 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 23563 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 23564 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23565 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23566 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccccgccttcagcgaccaccagtggctggacgacgccgggggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23567 - DNA, 393 bp, Artificial
  Mutation in BnaC.FAD2.b introduced by TALE nuclease pair BnFAD2_T02
cctctcctccctcaccctctcccttacctcgccgggcccctctactgggcctgccaaggctgcgtcctaacgggcctctgggtcatcgcccacgaatgcggccaccacgccttcagcgactaccaggggctggacgacaccgccggcctcatcttccactccttcctcctcgccccttacttctcctggaagtacaacactggctccctcgagagagacgaagtgtctgtcatcgacgccaccattccaacaccggatccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23568 - DNA, 408 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcctttcgttttaattgatgcctggcagttccctattctcgtgttgaatacagccatcgacaccaccactccaacaccgggtccctcgagagggatgaagtgttcgtccccaagaagaaatcccacatccagtggtacggaaagtacctcaacaacccgctaggacgcacggtgatgctagccgtccaggtcacgctcggctggccttcatactcag

SEQ ID NO: 23569 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 23570 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacatcccgctaggacgcacggtgatgctaaccgtccagttcacgctcggctggcctttgtacttag

SEQ ID NO: 23571 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgcgcggctggcctttgtacttag

SEQ ID NO: 23572 - DNA, 453 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcctcttccactccttcctcctcgtcccttacttctcccactggtcggccacgggtttacacacgcgcacatcgttgcgttaagccaacacccggcagcgttagggaccgtcgctgtcaagtatcaggacatgatcgcatttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23573 - DNA, 357 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccagtccaacaccggatccctcgagagggatgaagtgttcgtccccaagaagaaatccgacatcaagtggtacggaaagtacctcaacaacccgctaggacgcacggtggttctaaccgtccagttcacgctcggctggcctttgtacttag

SEQ ID NO: 23574 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctcacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23575 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctatgacgcacggtgatgctaaccgtccagttcacgctcggctggcctttgtacttag

SEQ ID NO: 23576 - DNA, 351 bp, Artificial
  Mutation in BnaC.FAD2.b introduced by TALE nuclease pair BnFAD2_T02
cctctcctccctcaccctctctcctgcttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23577 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 23578 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23579 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacacctgatccctcgagagggatgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 23580 - DNA, 365 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaacagccatcgacgccaccattccaacaccggatccctcgagagggatgaagtgttcgtccccaagaagaaatccgacatcaagtggtacggaaagtacctcaacaacccgctaggacgcgcggtgatgctatccgtccagttcacgcgtggctggccttggtacttag

SEQ ID NO: 23581 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaacccttcgggacgcaccgtgatgttaacggttcagttcactctcggctggcctttgtacttag

SEQ ID NO: 23582 - DNA, 362 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23583 - DNA, 387 bp, Artificial
  Mutation in BnaC.FAD2.b introduced by TALE nuclease pair BnFAD2_T02
cctctcctccctcaccctctcccttacctcgcctcgcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccccccagcaggtggtggccatcgccagcaatagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23584 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaacccgacatcaagtggtacggaaagtacctcaacaacccgctaggacgcacggtgatgctaaccgtccagttcacgctcggctggcctttgtacttag

SEQ ID NO: 23585 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagccatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23586 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23587 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23588 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcgacgccaccattccaacaccggatccctcgagagggatgaagtgttcgtccccaagaagaaatccgacatcaagtggtacggcaagtacctcaacaaccctttgggacgcaccgtgatgttaacggttcagttcactcgcggctggcctttgtacttag

SEQ ID NO: 23589 - DNA, 356 bp, Artificial
  Mutation in BnaC.FAD2.b introduced by TALE nuclease pair BnFAD2_T02
cctctcctccctcaccctctcccttacctctcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatctacgccaccattccaacaccggatccctcgagagggatgaagtgttcgtccccaagaagaagccagacatcaagtggcccggcaattactcgaccacccctgtgggacgtaccgggatgttacccgttcagttccctctcggctggcctttgtacttag

SEQ ID NO: 23590 - DNA, 337 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcttccacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23591 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacctcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23592 - DNA, 357 bp, Artificial
  Mutation in BnaC.FAD2.b introduced by TALE nuclease pair BnFAD2_T02
cctctcctccctaaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23593 - DNA, 376 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtccgctggaccgtctccagcgcctgcttgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23594 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgatcggctggcctttgaacttag

SEQ ID NO: 23595 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccctcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23596 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggccgttgtacttag

SEQ ID NO: 23597 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23598 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23599 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23600 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcatttgtacttag

SEQ ID NO: 23601 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccctcgacgccaccattccaacaccggagccctcgagagggatgaagtgttcgtccccaagaagaaagccgacatcaagtggtacggaaagtacctcaacaacccgctaggacgcacggggatgctaaccgtccatttcacgcgcggctggcctttgtacttag

SEQ ID NO: 23602 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggacaccagtccaacactggctccctcgagagggatgaagtgttcgtccccatgaagaaatccgacatcaagtggtacggaaagtacctcaacaacccgctaggacgcacggtgatgctaaccgtccagttcacgctcggctggcgtttgtacttag

SEQ ID NO: 23603 - DNA, 343 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttgccatcgacgccaccattccaacaccggatacctcgagagggatgaagtgttcgtccccaagaagaaatccgacatcaagtggtacggaaagtacctcaacaacacgctaggacgcacggggatgctaaccgtccagtgcacgctcggctggcctttgtacttag

SEQ ID NO: 23604 - DNA, 358 bp, Artificial
  Mutation in BnaC.FAD2.b introduced by TALE nuclease pair BnFAD2_T02
cctctcctccctcaccctctgccttacctcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaagtcagacatcaagtggtacggcaagtacctcaacaaccctttgggacgcaccgggatgttaacggttcatttcactcgcggctggcctttgtacttag

SEQ ID NO: 23605 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctcttggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacacccctttgggacgcaccgtgatgttaacggttcagttcacgctcggctggcctttgtacttag

SEQ ID NO: 23606 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23607 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactcctttctcctcgtcccttactcctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23608 - DNA, 362 bp, Artificial
  Mutation in BnaC.FAD2.b introduced by TALE nuclease pair BnFAD2_T02
cccctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23609 - DNA, 357 bp, Artificial
  Mutation in BnaC.FAD2.b introduced by TALE nuclease pair BnFAD2_T02
cctctcctccctcaccctctcccttacctcgcctggcctctctactgggcccgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23610 - DNA, 357 bp, Artificial
  Mutation in BnaC.FAD2.b introduced by TALE nuclease pair BnFAD2_T02
cctctcctccctcaccctctcccttacctcgcctcgcccctctactgggcctgccaaggctgcgtcctaaccggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtgatacggaaagtacctcaacaacccgctaggacgcacggtgatgctaaccgtccagttcacgcgcggcgggccgtggtacttag

SEQ ID NO: 23611 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctactggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23612 - DNA, 362 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtggctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 23613 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgagtcatcgcccacgaatgcggccaccacgccttcagcgaccaccagtggctggacgacgccgtgggcctcgtcttccactccttcctcctcgtcccttacttctcctggaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23614 - DNA, 346 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttccatcgacgccaccattccaacaccggatccctcgagagggatgaagtgttcgtccccaagaagaaatccgccatcaagtggtacggaaagtacctcaacaacccgctaggacgcccggtgatgctaaccgtccagttcacgctcggctggcatttgtacgtag

SEQ ID NO: 23615 - DNA, 352 bp, Artificial
  Mutation in BnaC.FAD2.b introduced by TALE nuclease pair BnFAD2_T02
cctctcctccctcaccctctcccttacctcgcctggaccctccactgcgcctgccaaggctgcgtcctaacgggactctgggtcatcgcccacgaatgcggccaccacgccttcagcgaccaccagtggctggacgacgccgtgggcctcgtcttccactccttcctcctcgtcccctacttctgaagccatcaacgccaccattccaacaccggatccctcgagagggatgaagtgttcgtccccaagaagaaatccgacatcaagtggtacggaatgtacctcaacaacccgctatgacgcacggtgatggtaaccgttcagttcacgcgcagctggcgattgtacttag

SEQ ID NO: 23616 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23617 - DNA, 343 bp, Artificial
  Mutation in BnaC.FAD2.b introduced by TALE nuclease pair BnFAD2_T02
cctctcctccctcaccctctctcctacttcgcctggccactctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttgccatcgacgccaccattccaacaccggatccctcgagagggatgaagtgttcgtccccaagaagaaatccgacatcaagtggtacggaaagtacctcaacaacccgctaggacgcacggtgatggtaaccgtccagttcacgctcggctggcctttgtacgtag

SEQ ID NO: 23618 - DNA, 273 bp, Artificial
  Mutation in BnaC.FAD2.b introduced by TALE nuclease pair BnFAD2_T02
cctctcctccctcaccctctacattacctcgcctggcccctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 23619 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaatactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23620 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtcccaagaagaaatccgacatcaagtggtacggaaagtacctcaacaacccgctaggacgcacggtgatgctaaccgtccagttcacgctcggctggcctttgtacttag

SEQ ID NO: 23621 - DNA, 347 bp, Artificial
  Mutation in BnaC.FAD2.b introduced by TALE nuclease pair BnFAD2_T02
cctctcctccctcaccctctcccttacctcgcctggaccctctactgagcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtatctcagcaagcgtctagggtgcacgggggtgcgaaccgcccagttcacgctcggctggcctttgtacttag

SEQ ID NO: 23622 - DNA, 362 bp, Artificial
  Mutation in BnaC.FAD2.b introduced by TALE nuclease pair BnFAD2_T02
cctctcctccctcaccctctcccttacctcacctggcccctctactgggcctgccaaggctgcgtcctaacgggcctctgggtcatcgcccacgagtgcggccaccacgccttcagcgaccaccagtggctggacgacgccgtgggcctcgtcttccactccttcctcctcgtcccttacttctcctggaaagtggctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23623 - DNA, 356 bp, Artificial
  Mutation in BnaC.FAD2.b introduced by TALE nuclease pair BnFAD2_T02
ccctcctccctcaccctctcccttacctcgcctggcccctctactgcgcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23624 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23625 - DNA, 356 bp, Artificial
  Mutation in BnaC.FAD2.b introduced by TALE nuclease pair BnFAD2_T02
cctctcctccctcaccctctcccttacctcgcctagcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagccagcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 23626 - DNA, 332 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaaatccgacatcaagtggtacggaaagtacctcaacaacccgctaggacgcacggtgatgctaaccgtccagttcacgcgcggctggcctttgtacttag

SEQ ID NO: 23627 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtcaagttcacgctcggctggccgttgtacttag

SEQ ID NO: 23628 - DNA, 384 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgatcaccagtggctggacgacgccgtgggcctcgtcttccactccttcctcctcgtcccttacgccgaggcgacacacgaagcgatcgttggcgtcggcaaacacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23629 - DNA, 362 bp, Artificial
  Mutation in BnaC.FAD2.b introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagttatcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23630 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23631 - DNA, 357 bp, Artificial
  Mutation in BnaC.FAD2.b introduced by TALE nuclease pair BnFAD2_T02
cctctcctccctcaccctctcccttacctcgcctcgcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23632 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 23633 - DNA, 401 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtactgcccgctttccagtcgggaaacctgtcgtgccagctgcaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23634 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtggcgccatcgacgccaccattccaacaccggatccctcgagagggatgaagtgttcgtccccaagaataaatccgacatcaagtggtacggaaagtacctcaacaacccgctaggacgcacggtgatgctaaccgtccagttcacgctcggctggcctttgtacttag

SEQ ID NO: 23635 - DNA, 360 bp, Artificial
  Mutation in BnaC.FAD2.b introduced by TALE nuclease pair BnFAD2_T02
cctctcctccctcaccctatcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgtggtacttag

SEQ ID NO: 23636 - DNA, 356 bp, Artificial
  Mutation in BnaC.FAD2.b introduced by TALE nuclease pair BnFAD2_T02
cctctcctccctcaccctctcccttacctcgcctggcccctctactgcgcctgccaaggccgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttaacgctcggctggcctttgtacttag

SEQ ID NO: 23637 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggccgttgtacttag

SEQ ID NO: 23638 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 23639 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 23640 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 23641 - DNA, 358 bp, Artificial
  Mutation in BnaC.FAD2.b introduced by TALE nuclease pair BnFAD2_T02
cctctcctccctcaccctgtcccttacctcgcctggccactctactgcgcctgccaaggctgcgtcctaacgggcctctgggtcatcgcccacgaatgcgcccaccacgccttcagcgaccaccagtggctggacgccgccgtgggcctcgtcttccactccttcctcctcgtcccttacttctcctggaagtaccatcgacgccaccagtccaacaccggatccctcgagagggatgaagtgttcgtccccaagaagaaatccgacatcaagtggtacggcaagtacctcaacaaccctttgggacgcgccgtgtgtgtaacggttcaggtcactcctggcgggccttagtccttag

SEQ ID NO: 23642 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23643 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23644 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23645 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23646 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgccctaacggccctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23647 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23648 - DNA, 357 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcacgcccggctggcctttgtacttag

SEQ ID NO: 23649 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggtctcatcttccactccttcctcctcgtcccttacttctccacgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23650 - DNA, 362 bp, Artificial
  Mutation in BnaC.FAD2.b introduced by TALE nuclease pair BnFAD2_T02
cctctcctccctcaccctctccgttacctcgccttgcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgactccaccattccaacaccggatccctcgagagagacgaagtgtttgtcctcaagaagacgtcagacatcaagtggtacggcaagtacctcaacatccctttgggatgccccgggatgttaacggttcagttcacgctcggctggcagttgcacttag

SEQ ID NO: 23651 - DNA, 408 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcgctctcctgttccgaccctgccgcttaccggatacctgtccgcctttctgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttgtacttag

SEQ ID NO: 23652 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaacagtggcttgacgacaccgtcggtctaatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgccaggacgcacggtgatgctaaccgtccagttcacgctcggctggccttagtgcttag

SEQ ID NO: 23653 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgtttgtccccaagaagaagtcagacatcaagtggtacggcaagtacctcaacacccctttgggacgcaccgtgatgttaacggttcagttcactctcggctggcctttgtacttag

SEQ ID NO: 23654 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23655 - DNA, 357 bp, Artificial
  Mutation in BnaC.FAD2.b introduced by TALE nuclease pair BnFAD2_T02
cctctcctccctcaccctctcacttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23656 - DNA, 358 bp, Artificial
  Mutation in BnaC.FAD2.b introduced by TALE nuclease pair BnFAD2_T02
cctctcctccctcaccatctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23657 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 23658 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaataagaaatccgacatcaagtggtacggaaagtacctcaacaacccgctaggacgcacggtgatgctaaccgtccagttcacgctcggctggcctttgtacttag

SEQ ID NO: 23659 - DNA, 355 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctctgggacgcacggtgatgctaaccgtccagttcacgctcggctggcctttgtacttag

SEQ ID NO: 23660 - DNA, 362 bp, Artificial
  Mutation in BnaC.FAD2.b introduced by TALE nuclease pair BnFAD2_T02
cctctcctccctcaccctctccattacctcgcctggcccctccactgagcctgccaaggctgcgtcctaacgggcctctgggtcatcgcccacgaatgcggccaccacgccttcagcgaccaccagtggctggacgccgccgtgggcctcgtcttccactccttcctcctcctcccttacttctcctggaagttacagccatcgacgccaccattccaacaccggatccctcgagagggatgaagtgttcgtccccaagaagaaatccgacatcaagtggtacggaaagtacctcaacgaccctcttagacgcacggtggttctaaccgtccaggtcaggctccgctggccttagtacttag

SEQ ID NO: 23661 - DNA, 362 bp, Artificial
  Mutation in BnaC.FAD2.b introduced by TALE nuclease pair BnFAD2_T02
cctctactccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23662 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23663 - DNA, 273 bp, Artificial
  Mutation in BnaC.FAD2.b introduced by TALE nuclease pair BnFAD2_T02
cctctcctccctcaccctctcccttacctcgcctcgcccctctactgggcctgccaaggctgcgtcctaacgggcctctgggtcatcgcccacgaatgcggccaccacgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23664 - DNA, 359 bp, Artificial
  Mutation in BnaC.FAD2.b introduced by TALE nuclease pair BnFAD2_T02
cctctcctccctcaccctctctactacttcgcctggcctctctactgggcctgccaaggctgcgtcctaacgggcctctgggtcatcgcccacgagtgcggccaccacgccttcagcgaccaccagtggctggacgacgccgtgggcctcgtcttccactccttcctcctcgtcccttacttctcctggaagttgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgcccggctggccgttgtacttag

SEQ ID NO: 23665 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagccactaccagtggcttcacgacaccgtcggtctcatcttccactccttcctcctcgtcccttacttctcctggaagtcatcgacgccaccattccaacaccggatccctcgagaggcatgaagtgttcgtccccaagaagaaatcccacatcaagtggtacggaaagtagctcaacaacccgccaggacgcacggtgatgctacccgtccagtgcgcgctcggctcgcctttgcacttag

SEQ ID NO: 23666 - DNA, 357 bp, Artificial
  Mutation in BnaC.FAD2.b introduced by TALE nuclease pair BnFAD2_T02
cctctcctccctcaccctctcccctacttcgcctggcctctctactgcgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggccgttggacttag

SEQ ID NO: 23667 - DNA, 350 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23668 - DNA, 362 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23669 - DNA, 287 bp, Artificial
  Mutation in BnaC.FAD2.b introduced by TALE nuclease pair BnFAD2_T02
cctctcctccctcaccctttctactacttcgcctggcctctctactgggcctgccaagggtgcgtcctaaccggcgtctgggtcatagcccacgagtgcggccaccacctgctccggggtcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 23670 - DNA, 349 bp, Artificial
  Mutation in BnaC.FAD2.b introduced by TALE nuclease pair BnFAD2_T02
cctcctccctcaccctctcgcttacctcgcctggtgcctctactgggcctgccaaggctgcgtcctcacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23671 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagatggatgaagtgttcgtccccaagaagaaatccgacatcaagtggtacggaaagtacctcaacaacccgctaggacgcaccgtgatgttaacggttcagttcacgctcggctggccgttgtacttag

SEQ ID NO: 23672 - DNA, 356 bp, Artificial
  Mutation in BnaC.FAD2.b introduced by TALE nuclease pair BnFAD2_T02
cctctcctccctcaccctctcccttacctcgccttgcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23673 - DNA, 360 bp, Artificial
  Mutation in BnaC.FAD2.b introduced by TALE nuclease pair BnFAD2_T02
cctctcctccctcaccctctctcctacttcgcctggcctctctactgggcctaccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23674 - DNA, 358 bp, Artificial
  Mutation in BnaC.FAD2.b introduced by TALE nuclease pair BnFAD2_T02
cctctcctccctcaccctctctcctacttcgcctggcctctctactaggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtgcatgtcacgcgcggctggcctttgtacttag

SEQ ID NO: 23675 - DNA, 354 bp, Artificial
  Mutation in BnaC.FAD2.b introduced by TALE nuclease pair BnFAD2_T02
cctctcctcctcaccctctctactacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 23676 - DNA, 294 bp, Artificial
  Mutation in BnaC.FAD2.b introduced by TALE nuclease pair BnFAD2_T02
cctctcctccctaaccctctcccttacctcgcctggcacctctactgggcctgccaaggctgcgtcctaacgggcctctgggtcatcgcccacgaatgcggccaccacgccttcagcgactaccagtggctggacgacaccgtcggcctcctcttccactccttcctccttgtcaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23677 - DNA, 359 bp, Artificial
  Mutation in BnaC.FAD2.b introduced by TALE nuclease pair BnFAD2_T02
cctctcctccctcaccctctcacttacctcgcctggcacctctcctgagcctgccaaggatgcgtcccaacgggcctctgggtcatcgcccacgaatgcggccaccacgacatcagcgaccaccagtggctggacgacgccgggggcctcgtctcccactccttcctcctcgtcccttacttctcctggaagtagccatcgacgccaccattccaacacccgatccctcgagagcgatgaagtgttcgtacccaagaagaaatccgacatcgagtggtacggaaagtacctcaacaacccgctaggacgcacggtgatgctaaccgtccagttcacgctcggctggcctttgtacttag

SEQ ID NO: 23678 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgtttgtccccaagaagaagtcagacatcaagtggtacggcaagtacctcaacaaccctttgggacgcaccgttatgttaacggttcagttcactctcgtctggcctttgtacttag

SEQ ID NO: 23679 - DNA, 362 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23680 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcggcctaaccggcgtctgggtcatagcccacgagtgcgtccaccacgccttcagcgaccaccagtggctggacgacgccgcgggcctcgtcttccactccttcctcctcgtcccttacttctcctggaagtagccatcgacgccaccattccaacaccggatccctcgagagggatgaagtgttcgtccccaagaagaaatccgacatcacgtggtacggatagtacctcaacaacccggtaggacgcacggtgatgctaatcctccagttcacgctcggctggcctttgtacttag

SEQ ID NO: 23681 - DNA, 359 bp, Artificial
  Mutation in BnaC.FAD2.b introduced by TALE nuclease pair BnFAD2_T02
cctctcctccctcaccctctcccttacctcgcctggcccctttactgggcctgccaaggctgcgtcctaacgggcctctgggttatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagagatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23682 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23683 - DNA, 356 bp, Artificial
  Mutation in BnaC.FAD2.b introduced by TALE nuclease pair BnFAD2_T02
cctctcctccctcaccctctcccttacctcgcctggcccctctactgagcctgccaaggctgcgtcctaacgggcctctgggtcatcgcccacgaatgcggccaccccgccttcagcgaccaccagtggctggacgacgccgttggcctcatcttccactccttcctcctcgtcccttacttctcctgcaaagcatcgacgccaccattccaaccccggatccctcgcgagtgatgaagtgttcgtccccaagaagaaatccgacatcacgtggtacggaaagtacctcaacaacccgctaggacgcacggtggggctaaccgtccagttcacgctcggctggcctttgtacttag

SEQ ID NO: 23684 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttcctcatcgacgccaccattccaacactggctccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 23685 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23686 - DNA, 355 bp, Artificial
  Mutation in BnaC.FAD2.b introduced by TALE nuclease pair BnFAD2_T02
cctctcctccctcaccctctctcctacttcgcctggccactctcctgcgcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggccgttgtacttag

SEQ ID NO: 23687 - DNA, 356 bp, Artificial
  Mutation in BnaC.FAD2.b introduced by TALE nuclease pair BnFAD2_T02
cctctcctccctcaccctctctactacttcgcctggcccatctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactag

SEQ ID NO: 23688 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggaaagtacctcaacaacccgctaggacgcactgtgatgctaaccgtccagttcacgctcggctggcctttgtacttag

SEQ ID NO: 23689 - DNA, 349 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 23690 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 23691 - DNA, 350 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggcgggcctttgtacttag

SEQ ID NO: 23692 - DNA, 350 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23693 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggaaagtacctcaacaacccgctacgacgcacggtgatgctaaccgtccagttcacgctcggctggcctttgtacttag

SEQ ID NO: 23694 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgtgtcatcgcccacgaatgcggccaccacgccttcagcgaccaccagtggctggacgacgccgtgcgcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 23695 - DNA, 336 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaaatccgacatcaagtggtacggaaagtacctcaacaccccgctaggacgcacggtgatgctaaccgtccagttcacgctcggctggcctttgtacttag

SEQ ID NO: 23696 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtttcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23697 - DNA, 273 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23698 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtaccttaacaacccgctaggatgcccggtgatgctaaccgtccagttctcgctcggctggccgttgtacttag

SEQ ID NO: 23699 - DNA, 356 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaataaatccgacatcaagtggtacggaaagtacctcaacaacccgctaggacgcacggtgatgctaaccgtccagttcacgctcggctggcctttgtacttag

SEQ ID NO: 23700 - DNA, 336 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgactaccagtggctggacgacaccgtcggcctcatcttccactccttcctcctcgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23701 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23702 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaaagccatcgacgccaccattccaacaccggatccctcgagagggatgaagtgttcgtccccaagaagaaatccgacatcaagtggtacggaaagtacctcaacaacccgctagaacgcacggtgatgctaaccgtccagttcacgctcggctggcctttgtacttag

SEQ ID NO: 23703 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgatgttccacattacgctatcgataacgccggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23704 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23705 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23706 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagaggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23707 - DNA, 360 bp, Artificial
  Mutation in BnaC.FAD2.b introduced by TALE nuclease pair BnFAD2_T02
cctctcctccctcaccctctctcctacttcgcctggcctctctcctgagcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23708 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23709 - DNA, 356 bp, Artificial
  Mutation in BnaC.FAD2.b introduced by TALE nuclease pair BnFAD2_T02
cctctcctccctcaccctatcccttacctcgcctcgcctctctaccgcgcctgccagggctgcgtcctaaccggcgtctgggtcatagcccacgagtgcggccaccccgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 23710 - DNA, 310 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtcggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23711 - DNA, 346 bp, Artificial
  Mutation in BnaC.FAD2.b introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgaggctaaccgtccaggtcacgctcggctggcctttgtacttag

SEQ ID NO: 23712 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcataacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaagtccgacatcaagtggtacggaaagtacctcaacaaccggctaggacgcgcggtggtgccaacggtccaggtcacgttgggctgccctttgtacgtgg

SEQ ID NO: 23713 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagaagccatcgacgccaccattccaacaccggatccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 23714 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcggcccttacttcgcctggaaagccatcgacgccaccattccaacaccggatccctcgagagggatgaagtgttcgtccccaagatgaaatccgacatcaagtggtacggaaagtacctcagcaacccgcgaggacgcacggtgatgctaaccgtccagttcacgctcggctggcctttgtacttag

SEQ ID NO: 23715 - DNA, 352 bp, Artificial
  Mutation in BnaC.FAD2.b introduced by TALE nuclease pair BnFAD2_T02
cctctcctccctcaccctctccattacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23716 - DNA, 347 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23717 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23718 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccacggctgcgtcctaacgggcctctgggtcatcgcccacgaatgcggccaccacgccttcagcgaccaccagtggctggacgacaccgtcggcctcatcttccactccttcctcctcgtcccttacttctcctggaagtatcatcgacgccaccattccaacactggctccctcgagagagacgaagtgtttgtccccaagaagaaatccgacatcaagtggtacggaaattacctcaacaacccgctagtacgcacggtaatcctaaccgtccagtccacgctcggctggcctttgtacttag

SEQ ID NO: 23719 - DNA, 356 bp, Artificial
  Mutation in BnaC.FAD2.b introduced by TALE nuclease pair BnFAD2_T02
cctctcctccctcaccctctcccttacctcgcctggcccctctactcggcctgccaaggctgcgtcctaacgggcctctgggtcatcgcccacgaatgcggccaccacgccttcagcgaccaccagtcgctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaaccgtttgggacgaaccgtgatgttaacggttcagttcacgctcggctggcctttgtacttag

SEQ ID NO: 23720 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23721 - DNA, 394 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctaccattattgctggcgatggccaccacctgctagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 23722 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23723 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggcctcatcttccactccttcctcctcgtcccttacttctcctggaaagccatcgacgccaccattccaacaccggctccctcgagagggacgatgtgttcgtccccaagaagaaatccgacatcaagtggtacggaaagtacctcaacaacccgctaggacgcacggtgatgctaaccgtccagttcacgctcggctggcctttgtacttag

SEQ ID NO: 23724 - DNA, 357 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23725 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacgacccgctaggacgcacggtgatgctaaccgtccagttcacgctcggctggcctttgtacttag

SEQ ID NO: 23726 - DNA, 383 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgagcctctgggtcatcgcccacgaatgcggccaccacgccttcagcgaccaccagtggctggacgacgccgtgggcctcgtcctgagtaggacaaatccgccgggagcggatttgaacgttgtgaagcaacggcccggagggtggcgggcgtcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 23727 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23728 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgcattcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23729 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaaccctctaggacgcacggtgatgctaaccgtccagttcacgctcggctggcctttgtacttag

SEQ ID NO: 23730 - DNA, 412 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtgctgaaccacatccccaactgcaacggcgccgtgctgtccgtggaggagctccagccagcgacgccaccattccaacaccggatccctcgagagggatgaagtgttcgtccccaagaagaaatccgacatcaagtggtacggaaagtacctcaacaacccgctaggacgcacggtgatgctaaccttccagttcaccctccgctggcatttgtacttag

SEQ ID NO: 23731 - DNA, 337 bp, Artificial
  Mutation in BnaC.FAD2.b introduced by TALE nuclease pair BnFAD2_T02
cctctcctccctcaccctctcccttacctcgcctttcccctctactgggcctgccaaggctgcgtcctaacgggcctctgggtcatcgcccacgaatgcggccaccacgccttcagcgaccaccagtggctggacgacgccgtgggcctggcacagcaccggcaacagccgcgccatcgacgccaccattccaacaccggatccctcgagagggatgaagtgttcgtccccaagaagaaatccgacatcaagtggtacggaaagtacctcagcaagccgctaggacgcacggtgatgctaaccgtccagttcacgctcggctggcctttgtacttag

SEQ ID NO: 23732 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23733 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23734 - DNA, 355 bp, Artificial
  Mutation in BnaC.FAD2.b introduced by TALE nuclease pair BnFAD2_T02
cctctcctccctcaccctctcccttacctcgcctggcccctctactgcgcctgccaaggctgcgtcctaacgggcctctgggtcatcgcccacgaatgcggccaccacgccttcagcgaccaccagtggctcgacgacgccgtgggcctcctcttccactccttcctcctcgtcccttacttctcctggaaacatcgacgccaccattccaacaccggatccctcgagatggatgaagtgttcgtccccaagaagaaatccgacatcaagtggtacggaaagtacctcaacaacccgctaggacgcacggtgaggctaaccgtccaggtcacgctcggcgggcctttgtacttag

SEQ ID NO: 23735 - DNA, 360 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcgcccaccacgccttcagcgaccaccagtggctggacgacgccgtgggcctcgtcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaccccgctaggacgcacggtgatgctaaccgtccaggtcacactcggctggcctttgtacttag

SEQ ID NO: 23736 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23737 - DNA, 365 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcctccgcgtcccttacttctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttggacttag

SEQ ID NO: 23738 - DNA, 336 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagctaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23739 - DNA, 273 bp, Artificial
  Mutation in BnaC.FAD2.b introduced by TALE nuclease pair BnFAD2_T02
cctctcctccctcaccctctcccttacctcgcctggcccctctactgggcctaccaaggctgcgtcctaacgggcctctgggtcatcgcccacaaatgcggccaccacgccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23740 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23741 - DNA, 407 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccatgggcctcgtcttccactccttcctcctcgtcccttacttctcctggaagttctccagcggcttttgccgccatcgtggctggcgatggccaccacctgagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23742 - DNA, 355 bp, Artificial
  Mutation in BnaC.FAD2.b introduced by TALE nuclease pair BnFAD2_T02
cctctcctccctcaccctctctcctacttcgcctggcctctctcctgagcctgccagggctgcgtcctaaccggcgtctgggtcatagcccatgagtgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 23743 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23744 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtgcttag

SEQ ID NO: 23745 - DNA, 358 bp, Artificial
  Mutation in BnaC.FAD2.b introduced by TALE nuclease pair BnFAD2_T02
cctctactccctcaccctctcacttacctcgcctgacccctctactcggcctgccaaggctgcgtcctaacgggcctctgggtcatcgcccacgaatgcggccaccccgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23746 - DNA, 358 bp, Artificial
  Mutation in BnaC.FAD2.b introduced by TALE nuclease pair BnFAD2_T02
cctctcctcccacaccctctcccttacctcgcctggcccctatactgggcctgccaaggctgcgtcctaacgggcatctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgttcgtccccaagaagaagtcagacatcaagtggtacggcaagtacctcaacaacccgttgggacgcaccgtgatgttaacggttcagttcactctcggctgtcctttgtacttag

SEQ ID NO: 23747 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaagtcagacatcaagtggtacggcaagtacctcaacacccctttgggacgcaccgtgatgttaacggttcagttcactctcggctggcctttgtacttag

SEQ ID NO: 23748 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagtgaccaccagtggctggacgacgccgtgggcctcgtcttccactccttcctcctcgtcccttacttctcctggaattcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23749 - DNA, 356 bp, Artificial
  Mutation in BnaC.FAD2.b introduced by TALE nuclease pair BnFAD2_T02
cctctcctccctcaccctctcccttacctcgcctggcccctctactgcgcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctctgctggcctttgtacttag

SEQ ID NO: 23750 - DNA, 353 bp, Artificial
  Mutation in BnaC.FAD2.b introduced by TALE nuclease pair BnFAD2_T02
cctcttctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggccgttgtccttag

SEQ ID NO: 23751 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagttttcgtccccaagaagaaatccgacatcaagtggtacggcaagtacctcaacaaccctttgggacgcaccgtgatgttaacggttcagttcactctcggctggcctttgtacttag

SEQ ID NO: 23752 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23753 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcctccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23754 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaagtcagacatcaagtggtacggcaagtacctcaacaaccctttgggacgccccgtgatgttaacggttcagttcactctcggctggcctttgtacttag

SEQ ID NO: 23755 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaacacgccttcagcgaccaccagtggctggacgacgccgtgggcctcgtcttccactccttcctcctcggcagtcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggccgttgtacttag

SEQ ID NO: 23756 - DNA, 394 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggacgccattgctggcgatggccaccacctgctggggggtcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23757 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 23758 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23759 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacatcaacaacccgctaggacgcacggtgatgctaaccgtccagttcacgctcggctggcctttgtacttag

SEQ ID NO: 23760 - DNA, 357 bp, Artificial
  Mutation in BnaC.FAD2.b introduced by TALE nuclease pair BnFAD2_T02
cctctcctccctcaccctttctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 23761 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23762 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagatgaagtcagacatcaagtggtacggcaagtacctcaacaacccggtgggacgcacggtgatgctaaccgtccagttcacgctcggctggcctttgtacttag

SEQ ID NO: 23763 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagttgtacggaaagtacctcaacaacccgctaggacgcacggtgatgctaaccgtccagttcacgctcggctggcctttgtacttag

SEQ ID NO: 23764 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaagactgcgtcctaaccggcgtctgggtcatagcccacgagtgcggccaccacgccttcagcgaccaccagtggctggacgacgccgtgggcctcgtcttccactccttcctcctcgtcccttacttctcctggaagtagtcatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 23765 - DNA, 347 bp, Artificial
  Mutation in BnaC.FAD2.b introduced by TALE nuclease pair BnFAD2_T02
cctctcctccctcaccctctcgcttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaattccctcaacaacccgctaggacacacggtgatgctaaccgtccagttcccgctcggctggcctttgtacttag

SEQ ID NO: 23766 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaccccgctaggacgcccggtgatgctacccgtccagttcacgctcggctggcctttgtacttag

SEQ ID NO: 23767 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23768 - DNA, 315 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 23769 - DNA, 349 bp, Artificial
  Mutation in BnaC.FAD2.b introduced by TALE nuclease pair BnFAD2_T02
cctctcctccctcaccctctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23770 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctattccaccattccaacaccggatccctcgagagagatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23771 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 23772 - DNA, 355 bp, Artificial
  Mutation in BnaC.FAD2.b introduced by TALE nuclease pair BnFAD2_T02
cctctactccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23773 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23774 - DNA, 348 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacaccgtcggcctcgtcttccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23775 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23776 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgcctcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23777 - DNA, 390 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaatgttccagattacgctatcgatatcgccggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactta

SEQ ID NO: 23778 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23779 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23780 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23781 - DNA, 396 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgactaccagtggctggacgacaccgtcggtctcatcttccactccttcctcctcgtcccttacttctccccacggcttgaccccccagcaggtggtggccatcgccattctccagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23782 - DNA, 402 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaaatccgacatcaagtggtacggcaagtacctcaacaacccgctaggacgcacggtgatgctaaccgcccagttcaagctcggctggcctctgtacttag

SEQ ID NO: 23783 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccacgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23784 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgttcggctggcctttgtacttag

SEQ ID NO: 23785 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 23786 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtcgtacggaaagtacctaaacagccccgtaggacgcaccgtgatgctaaccggccagttgtctcccggctggccgttgtacttag

SEQ ID NO: 23787 - DNA, 326 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23788 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtatctcaacaacccgctaggacgcacggtgatgctaaccgtccagttcacgctcggctggcctttgtacttag

SEQ ID NO: 23789 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 23790 - DNA, 435 bp, Artificial
  Mutation in BnaC.FAD2.b introduced by TALE nuclease pair BnFAD2_T02
cctctcctccctcaccctctcccttacctcgcctggcccctctactgggcctaccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttggacacaggccaacttctcaagattgcaaaacgtggcggcgtgaccgcagtggaggcagtgcatgcatggcgtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23791 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtaatcgcccacgaatgcggccaccacgccttcagcgaccaccagtggctggacgacgccgtgggcctcgtcttccactccttcctcctcgtcccttacttctcctggaaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23792 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 23793 - DNA, 357 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctgtgtacttag

SEQ ID NO: 23794 - DNA, 355 bp, Artificial
  Mutation in BnaC.FAD2.b introduced by TALE nuclease pair BnFAD2_T02
cctctcctccctcaccctctcccttacctcgcctggacactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctgtgtacttag

SEQ ID NO: 23795 - DNA, 337 bp, Artificial
  Mutation in BnaC.FAD2.b introduced by TALE nuclease pair BnFAD2_T02
cctctcctccctcaccctctcccttacctcgcctggcccctctactgggcctgacaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggaaagtacctcaacaacccgcgagtacgcacggtgatgctaaccgtccagttcacgcgcggctggcctttgtacttag

SEQ ID NO: 23796 - DNA, 357 bp, Artificial
  Mutation in BnaC.FAD2.b introduced by TALE nuclease pair BnFAD2_T02
cccctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23797 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 23798 - DNA, 392 bp, Artificial
  Mutation in BnaC.FAD2.b introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatgttctttcctgcgttatcccctgattctgtggatatcgacgccaccattccaacaccggatccctcgagagggatgaagtgttcgtccccaagaagaaatccgacatcaagtggtacggaaagtacctcaacaaccctgtgggacgcaccgtgatgttaacggttcagttcactctcggctggccttggtacgtag

SEQ ID NO: 23799 - DNA, 358 bp, Artificial
  Mutation in BnaC.FAD2.b introduced by TALE nuclease pair BnFAD2_T02
cctctcctccctcaccctctcccttacctcgcctggcccctctactgggcctgacaaggccgcgtcctaacgggcctctgggtcatcgcttacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaaatccgacaacaagtggtacggaaagtacctcaacaacccgctaggacgcacggtgatgctaaccgtccagttcacgctcggctggccttggtacttag

SEQ ID NO: 23800 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23801 - DNA, 412 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctgaaccacatcaccacctgcaacggcgccgtgctgtccgtggaggagctccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23802 - DNA, 354 bp, Artificial
  Mutation in BnaC.FAD2.b introduced by TALE nuclease pair BnFAD2_T02
cctctcctccctcaccctctcccttacctcgcctggcccctctactgggcctgcccaggctgcgtcctaacgggcctctgggtcctcgcccacgaatgcggccaccacgccttcagcgaccaccagtggctggacgacgccgtgggcctcgtcttccactccttcctcctcgtcccttacttctcctggaccatcgacgccaccattccaacaccggatccctcgagagggatgaagtgttcgtccccaagaagaaatccgacatcaagtggtacggaaagtacctcaacaaccctctaggacgcacggtgatgctaaccgtccagttcacgctcggctggcctttgtacttag

SEQ ID NO: 23803 - DNA, 274 bp, Artificial
  Mutation in BnaC.FAD2.b introduced by TALE nuclease pair BnFAD2_T02
cctctcctccctcaccctctctcctacttcgcctggcccctctactgggcctaccaaggctgcgtcctaacgggcctctgggtcatcgcccacgaatgcggccaccacgccttcagcgaccaccattccaacaccggatccctcgagagggatgatgtgttcgtccccaagaagaaatccgacatcaagtggtacggaaagtacctcaacaacccgctaggacgcacggtgatgctaaccgtccagttcacgctcggctggcctttgtacttag

SEQ ID NO: 23804 - DNA, 360 bp, Artificial
  Mutation in BnaC.FAD2.b introduced by TALE nuclease pair BnFAD2_T02
cctctcctccctcaccctctctcctacttcgcctggacactctactgggcctgccagggctgcgtcctaaccggcgtctgggtcatagcccacgagtgcggccaccacgccttcagcgaccaccagtggctggacgacgccgtgggcctcgtcttccactccttcctcctcgtgccttacttctcctggaacacagccatcgacgccaccattccaacaccggatccctcgagagtgatgaagtgttcgtccccaagaagaaatccgacatcaagtggtacggaaagtacctcaacaacccgctaggacgcacggggatgctaaccgtccagttcactctcggctggcctttgtacttag

SEQ ID NO: 23805 - DNA, 357 bp, Artificial
  Mutation in BnaC.FAD2.b introduced by TALE nuclease pair BnFAD2_T02
cctctcctccctcaccctctcccttacctcgcctggcccctctactggacctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23806 - DNA, 355 bp, Artificial
  Mutation in BnaC.FAD2.b introduced by TALE nuclease pair BnFAD2_T02
cctctcctccctcaccctctcccttacctcggctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23807 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23808 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 23809 - DNA, 359 bp, Artificial
  Mutation in BnaC.FAD2.b introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgtcctttgtacttag

SEQ ID NO: 23810 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23811 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23812 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtaatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaagccgacatcaagtggtacggaaagtacctcaacaacccgctaggacgcacggtgatgctaaccgtccagttcacgctcggctgtcctttgtacttag

SEQ ID NO: 23813 - DNA, 357 bp, Artificial
  Mutation in BnaC.FAD2.b introduced by TALE nuclease pair BnFAD2_T02
cctctcctccctcaccctctcccttacctcgcctggccaccctactcggcctgccaaggctgcgtcctaacggccctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaacgtactccaacaacccgctaggacgcacggggatgctaaccgtccagttcacgctcggctggcctgtgtacttag

SEQ ID NO: 23814 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagcaatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23815 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagccatcgacgccaccattccaacaccggatccctcgagagggatgaagtgttcgtccccaagaagaaatccgacatcaagttgtacggaaagtacctcaacaaccctttgggacgcaccgtgatgttaacggttcagttcactctcggctggcctttgtacttag

SEQ ID NO: 23816 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctccatcgacgccaccattccaacactggctccctcgagagagacgaagtgtttgtccccaagaagaaatccgacatcaagtggtacggaaagtacctcaacaacccgctaggccgcatggggattctaaccgtccagttcacgtccggctggcctttgtccttag

SEQ ID NO: 23817 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23818 - DNA, 407 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttctccagcggctgttgccgccatcgtggctggcgatggccaccacctgagccatcgacgccaccattccaacaccggatccctcgagagggatgaagtgttcgtccccaagaagaaatccgacatcaagttgtacggaaagtacctcaacaacccgctaggacgcacggtgatgctaaccgtccagttcacgctcggctggcctttgtacttag

SEQ ID NO: 23819 - DNA, 356 bp, Artificial
  Mutation in BnaC.FAD2.b introduced by TALE nuclease pair BnFAD2_T02
cctctcctccctcaccctctcccttacctcgcctggcccctctactgggcatgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23820 - DNA, 359 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccaccccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtatctcaacaagcctctaggacgcatggtgatcctacccgtccagttcaccctcggctggcctttgtacttag

SEQ ID NO: 23821 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtaccgcaacaacccgctaggacgcacggtgatgctaaccggccagttcacgctcggctggcctgtgtacttag

SEQ ID NO: 23822 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggctccctcgagagagatgaagtgttcgtccccaagaagaagtccgacatcaagtggtacggaaagtacctcaacaacccgctaggacgcacggtgatgctaaccgttcagttcacgctcggctggcctgtgtacttag

SEQ ID NO: 23823 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 23824 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacacagtcggcctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23825 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgcctgcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacagcccgctaggacgcacggtgaggctaaccgtccagttcacgctcggctggcctttgtacttag

SEQ ID NO: 23826 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23827 - DNA, 363 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcaagctcggctggcctttgtacttag

SEQ ID NO: 23828 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23829 - DNA, 360 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagccatcgacgccaccattccaacaccggatccctcgagagggatgaagtgttcgtccccaagaagaaagccgacatcaagtggtacggaaagtaccgctacaacccgctaggactcacggtgatgctaaccgtccatttcactctccggtacccagtgcacttag

SEQ ID NO: 23830 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtgttacggaaagtacctcaacaacccgctaggacgcacggtgatgctaaccgtccagttcacgctcggctggcctttgtacttag

SEQ ID NO: 23831 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccatgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23832 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaggggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 23833 - DNA, 357 bp, Artificial
  Mutation in BnaC.FAD2.b introduced by TALE nuclease pair BnFAD2_T02
cctctcctccctcaccctctctcctacttcgcctggactctctaatgggcctgccaagggtgcgtcctaaccggcgtctgggtcatagcccacgagtgcggccaccacgccttcagcgactaccagtggctggacgacaccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccttccagtgcacgctcggctggcctgtgtacttag

SEQ ID NO: 23834 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgttgggacgcacggtgatgctaaccgtccagttcacgcgcggctggccttggtacgtag

SEQ ID NO: 23835 - DNA, 356 bp, Artificial
  Mutation in BnaC.FAD2.b introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 23836 - DNA, 408 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccttgaccgaacgcagcggtggtaacggcgcagtggcggttttcatggcttgagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccttgtacttag

SEQ ID NO: 23837 - DNA, 359 bp, Artificial
  Mutation in BnaC.FAD2.b introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaggtacctctacaacccgctagaacgcacggtgatgctaaccttccagttgacgcgccgctggcctgagcacttag

SEQ ID NO: 23838 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 23839 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23840 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctgcacgacgccgtgggcctcgtcttccactccttcctcctcgtcccttccttctcctggaagccatcgacgccaccattccaacaccggatccctcgagagggatgaagtgttcgtccccaagaagaaatccgacatcaagtggtacggaaagtacctcaacaacccgctaggacgcccggtgattctaaccttccagttcacgctccgctggccttagtacttag

SEQ ID NO: 23841 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23842 - DNA, 425 bp, Artificial
  Mutation in BnaC.FAD2.b introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtacacacgcgcacatcgttgcgttaagccaacacccggcagcgttagggaccgtcgctgtcaagtatcagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcatgctcggctggcctttgtacttag

SEQ ID NO: 23843 - DNA, 356 bp, Artificial
  Mutation in BnaC.FAD2.b introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtggtcctcgtcttccactccttcctcctcgtcccttacttctcctggaagccatcgacgccaccattccaacaccggatccctcgagagggatgaagtgtttgtccccaagaagaagtcagacatcaagtggtacggcaagtacctcaagaacccggtgggacgcaccgggatgttaacggtggagttcactctcggctggcctgtgtacgtag

SEQ ID NO: 23844 - DNA, 346 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcatggtgatgctaaccgtccagttcacgctcggctggcctttgtacttag

SEQ ID NO: 23845 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23846 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23847 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacatag

SEQ ID NO: 23848 - DNA, 362 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaaagggcctctggggcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctagcacgcacggtgatgctaaacgtccagttcacgctcggctggcctttgtacttag

SEQ ID NO: 23849 - DNA, 343 bp, Artificial
  Mutation in BnaC.FAD2.b introduced by TALE nuclease pair BnFAD2_T02
cctctcctccctcaccctctcccttacctcgcctggcccctctactcggcctgccaaggctgcgtcctaacgggcctctgggtcatcgcacacgaatgcggccaccacgccttcagcgaccaccagtggctggacgacgccgtgggcctcgtcttccactccttcctcctcgtcccttgccatcgacgccaccattccaacaccggatccctcgagagggatgaagtgttcgtccccaagaagaaatccgacatcaagtggtacggaaagtacctcatcaacccgctaggacgcacggtgatgctaaccgtccagttcacgctcggctggcctttgtacttag

SEQ ID NO: 23850 - DNA, 355 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctatgacgcacggtgatgctaaccgtccagttcacgctcggctggcctttgtacttag

SEQ ID NO: 23851 - DNA, 273 bp, Artificial
  Mutation in BnaC.FAD2.b introduced by TALE nuclease pair BnFAD2_T02
cctctcctccctcaccctctcccttccctcgcctggcccccctactgggcctgccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggaaattacctcaacaacccgctaggacgcacggtgatgctaaccgtccagttcacgctcggctggcctttgtacttag

SEQ ID NO: 23852 - DNA, 363 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccatgccttcagcgaccaccagtggctggacgacgccgtgggcctcgtcttccactccttcctcctcgtcccttacttctcctggaagtatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccattgtacttag

SEQ ID NO: 23853 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgacagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23854 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23855 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaaccctttgggacgcaccgttatgttaacggttcagttcactctcggctggcctttgtacttag

SEQ ID NO: 23856 - DNA, 351 bp, Artificial
  Mutation in BnaC.FAD2.b introduced by TALE nuclease pair BnFAD2_T02
cctctcctccctcaccctctcccttacctcgcctggcccctccactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaagtcagacatcaagtggtacggcaagtacctcaacaaccctttgggacgccccgtgatgttaacggttcagttcactctcggctggcctttgtacttag

SEQ ID NO: 23857 - DNA, 356 bp, Artificial
  Mutation in BnaC.FAD2.b introduced by TALE nuclease pair BnFAD2_T02
gcctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagccatcgacgccaccattccaacactggctccctcgagagggatgaagtgttcgtccccaagaagaaatccgacatcaagtggtacggaaagtacctcaacaacccgctaggacgcacggtgattctaaccgtccagttcacgctcggctggcctttgtacttag

SEQ ID NO: 23858 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcatcgacgccaccagtccaacaccggatccctcgagagggatgaagtgttcgtccccaagaagaaatccgccatcaagtggtacggaaagtacctcaacaacccgctaggacgcacggtgatgctaaccgtccagttcacgctcgtctgtcctttgtacttag

SEQ ID NO: 23859 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaaccctctaggacgcacggtgatgctaaccgtccagttcacgctcggctggcctttgtacttag

SEQ ID NO: 23860 - DNA, 323 bp, Artificial
  Mutation in BnaC.FAD2.b introduced by TALE nuclease pair BnFAD2_T02
cctctcctcctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23861 - DNA, 358 bp, Artificial
  Mutation in BnaC.FAD2.b introduced by TALE nuclease pair BnFAD2_T02
cctctcctccctcaccctctcccttacctcgcccggcccctctactgggtctgccaaggctgcgtcctaacgcccctctgggtcaccgcccacgaatgcggccaccacgccttcagcgaccaccagaggccggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctacccgtccagttcacgctcggctggcctttgtacttag

SEQ ID NO: 23862 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcactctcggctggcctttgtacttag

SEQ ID NO: 23863 - DNA, 361 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgccacgaatgcggccaccaagccttcagcggccaccagtggctggacgacgccgtgggcctcgtcttcccctccttcctcctcggcccttacttctcctggaagtaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttatacttag

SEQ ID NO: 23864 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23865 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtactgaaagtacctcaacaaccctttgggacgcaccgtgatgttaacggttcagttcactctcggctggcctgtgtacttag

SEQ ID NO: 23866 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctccagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 23867 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctttcttctcctggaagtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgccctttgtacttag

SEQ ID NO: 23868 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccagtagtcatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 23869 - DNA, 370 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttacttactcgtcccctacaacctgcccatcggccaggccgacgccatcgacgccaccattccaacaccggatccctcgagagggatgaagtgttcgtccccaagaagaagtcagacatcaagtggtacggcaaggacctcaacaaccctttgggacgcaccgtgatgttaacggttcagttcactctcggctggcctttgtacttag

SEQ ID NO: 23870 - DNA, 362 bp, Artificial
  Mutation in BnaC.FAD2.b introduced by TALE nuclease pair BnFAD2_T02
cctctcctccctcaccctctcccttccctcgcctggcccctctactgggcctgccaaggctgcgtcctaccgggcttctgggtcatcgcccacgaatgcggcccccacgccttcagcgaccaccagtggctggccgacgccgtgggcctcgtcttccactccttcctcctcgtcccttacttctcctggaagtaaaagccatcgacgccaccattccaacaccggatccctcgagagggatgaagtgttcgtccccaagaagaaatccgacatcaagtggtacggaaattacctcaacaacccgctaggacgcacggtgattctaaccgtccagttcacgctcggctggcctttgtacttag

SEQ ID NO: 23871 - DNA, 357 bp, Artificial
  Mutation in BnaC.FAD2.b introduced by TALE nuclease pair BnFAD2_T02
cctctcctcactcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagttcctcagcaacccgctaggacgcacggtgatgctaaccgtccagttcacgctcggctgcctttgtacttag

SEQ ID NO: 23872 - DNA, 341 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23873 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23874 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcatcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctccccgtccagttcacgctcggctggcctttgtacttag

SEQ ID NO: 23875 - DNA, 357 bp, Artificial
  Mutation in BnaC.FAD2.b introduced by TALE nuclease pair BnFAD2_T02
cctctcctccctcaccctctccattacctcgcctggcccctccactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacatcccgctaggacgcacggtgatgctaaccgtacagttcacgctcggctggcctttgtacttag

SEQ ID NO: 23876 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23877 - DNA, 356 bp, Artificial
  Mutation in BnaC.FAD2.b introduced by TALE nuclease pair BnFAD2_T02
cctctcctccctcaccatctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcaatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 23878 - DNA, 356 bp, Artificial
  Mutation in BnaC.FAD2.b introduced by TALE nuclease pair BnFAD2_T02
cctctcctccctcaccctctcccttaccgcgcctggccactctaatgggcctgccaaggctgcgtcctaacgagccactgggtaatcgcgcacgaatgcggccaccacgcctgcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtccggcatctacggcaacatcactttggtacgcaccgcgatgctacccgtccagttctctctcggctggcctttgtacttag

SEQ ID NO: 23879 - DNA, 326 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggataaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23880 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctagtcccttacttctcctgatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 23881 - DNA, 355 bp, Artificial
  Mutation in BnaC.FAD2.b introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagggatgaagtgttcgtccccaagaagaaatccgacatcaagtggtacggaaagtacctcaacaacccgctaggacgcactgtgatgctaaccgtccagttcacgctcggctggcctttgtacttag

SEQ ID NO: 23882 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 23883 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacggcgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23884 - DNA, 356 bp, Artificial
  Mutation in BnaC.FAD2.b introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23885 - DNA, 401 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtactgcccgctttccagtcgggaaacctgtcgtgccagctgcaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 23886 - DNA, 354 bp, Artificial
  Mutation in BnaC.FAD2.b introduced by TALE nuclease pair BnFAD2_T02
ctctcctccctcaccctctcccttacctcgcctgacccctctactgggcctgccaaggctgcgtcctaacgggcctctgggtcatcgcccacgaatgcggccaccacgcattcagcgaccaccagtggctggacgacgccgtgggcctcgtcttccactccttcctcctcgtcccttacttctcctggagacatcgacgccaccattccaacaccggatccctcgagagggatgaagtggtcgtccccaagaagaaagccgacaacaagtggtacggaaagtacttcaacaacccgctaggacgcacggggatgctaaccttccagttcactctcggctggcctttgtacttag

SEQ ID NO: 23887 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23888 - DNA, 356 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23889 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23890 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaccaccggatccctcgagagggatgaagtgtttgtccccaagaagaagacagacatcaagtggtacggcaagtaccgcaacatgcctttgggacgcaccgtgatgtgatcggttcagttgactctcggctggcctttgtacttag

SEQ ID NO: 23891 - DNA, 344 bp, Artificial
  Mutation in BnaC.FAD2.b introduced by TALE nuclease pair BnFAD2_T02
cctcttctccctcaccctctctcctacttcgcctggcctctctactgggcctgccagggctgcgtcctaaccggcgcctgggtcatcgcccacgaatgcggccaccacgccttcagcgaccaccagtggctggacgacgccgtggtcctcgtcttccactccttcctcctcgtcccttacttatcgacgccaccattccaacaccggatccctcgagagggatgaagtgttcgtccccaagaagaaatccgacatcaagtggtacggaaagtacctcaacaacccgctaggacgcacggtgatgctaaccgtccaattcacgctcggctggcctttgtgcttag

SEQ ID NO: 23892 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacactggctccctcgagagagacgaagtgtttgtccccaagaagaagtcagacatcaagtggtacggaaagtacctcaagaccccgctaggacgcacggtgatgctaaccgtccagttctcgttcggcctgcccttagcacttag

SEQ ID NO: 23893 - DNA, 448 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctccgtggcggcgtgaccgcagtggaggcagtgcatgcatggcgccgatctacgcacgctcggctacagccagcagcaacaggagaagatcaaaccgaaggttcatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 23894 - DNA, 343 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23895 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacaccgtgggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23896 - DNA, 452 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtacggccaccacctgctccggggtcaagccgtgggcctggcacaggtggaaacttcggcttcccctggagagagcgagattctccgcgctgtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23897 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23898 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 23899 - DNA, 356 bp, Artificial
  Mutation in BnaC.FAD2.b introduced by TALE nuclease pair BnFAD2_T02
cctctcctccctcaccctctcccttacctcgcctggcccctctactgtgcctgccaaggctgcgtcctaacgggcctctgggtcatcgcccatgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaacccgctgggacgcaccgggatgttaacggttcagttcaccctcggctggcctttgtacttag

SEQ ID NO: 23900 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagagatgaagtgttcgtccccaagaagaaatccgacatcaagtggtacggaaagtacctcaacaacccgctagaacgcacggcgatgctaaccgtccagttcacgctcggctggcctttgtacttag

SEQ ID NO: 23901 - DNA, 356 bp, Artificial
  Mutation in BnaC.FAD2.b introduced by TALE nuclease pair BnFAD2_T02
cctctcctccctcaccctctcccctacttcgcctggcctctctactgggcctgacaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23902 - DNA, 356 bp, Artificial
  Mutation in BnaC.FAD2.b introduced by TALE nuclease pair BnFAD2_T02
cctctcctccctaccctctcccttaccccgcctggcccctctactgggcctgccaaggctccgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccggtaggacgcacgagaaggctaaccgaccagttcacgctcggctggccttggtacttag

SEQ ID NO: 23903 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtatgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23904 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagttgtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23905 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 23906 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23907 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 23908 - DNA, 350 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23909 - DNA, 337 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23910 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 23911 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtaacagtcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 23912 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23913 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgaagctaaccgtccagttcacgctcggctggcctttgtacttag

SEQ ID NO: 23914 - DNA, 350 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtattccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23915 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagggatgaagtgttcgtccccaagaagaaatccgacgtcaagtggtacggaaagtacctcaacaaccctttgggacgcaccgtgatgctaaccgtccagttcacgctcggctggcctttgtacttag

SEQ ID NO: 23916 - DNA, 392 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcctggaagtgggcctggcacagcaccggcaagcaggcgctggagtcatcgacgccaccattccaacactggctccctcgagagagacgaagtgttggtccccaagaagaaaaccgacagcaagtggtacggaaagtacctcaacaacccgctaggacggacggtgatgctaaccgtccagttcacgctcggctggcctttgtacttag

SEQ ID NO: 23917 - DNA, 346 bp, Artificial
  Mutation in BnaC.FAD2.b introduced by TALE nuclease pair BnFAD2_T02
cctctcctccctcaccctctaccttacctcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcacggctggcctttgtacttag

SEQ ID NO: 23918 - DNA, 365 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcctcctcgtcccttacttctcatcgacgccaccattccaacaccggatccctcgagagggatgaagtgttcgtccccaagaagaagtcagacatcaagtggtacggcaagtacctcaacaaccctttgggacgcaccgtgatgttaaccgtccagttcacgctcggctggcctttgtacttag

SEQ ID NO: 23919 - DNA, 335 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgattacttag

SEQ ID NO: 23920 - DNA, 356 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23921 - DNA, 358 bp, Artificial
  Mutation in BnaC.FAD2.b introduced by TALE nuclease pair BnFAD2_T02
cctctcctccctcaccctctcccttacctcgcctggcccctctaccgggcctgccaaggctgcgtcctcacgggcctctgggtcaccgcccacgaatgcggccaccacgccttcagcgaccaccagtggctggacgacgccgtgggcctcgtcttccactccttccccctcgtcccttacttctcctggaaaagccatcgacgccaccattccaacaccggatccctcgagagggatgaagtgttcgtccccaagaagaaatccgacatcaagtggtacgggaagtacctcaacaacccgctaggacgcacggtgatgctaaccctccagttcacgctcggcaggcctctgtgcttag

SEQ ID NO: 23922 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccggaagtacagccatcgacgccaccattccaacaccggatccctcgagagggatgaagtgttcgtccccaagaagaaatccgacatcaagtggtacggaaaggacctcaacaacccgctaggacgcacggtgatgctaaccgtccagttcacgctcggctggcctttgtacttag

SEQ ID NO: 23923 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcccctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23924 - DNA, 408 bp, Artificial
  Mutation in BnaC.FAD2.b introduced by TALE nuclease pair BnFAD2_T02
cctctcctccctcaccctctcccttacctcgcctggcccctctactgggcctgacaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcctttcgttttaattgatgcctggcagttccctattctcgtgttgaatacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcgtctggcctttgtacttag

SEQ ID NO: 23925 - DNA, 355 bp, Artificial
  Mutation in BnaC.FAD2.b introduced by TALE nuclease pair BnFAD2_T02
cctctcctccctcaccctctctcctacttcgcctggcctatctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23926 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23927 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggattcatcgacgccaccattccaacaccggatccctcgagagggatgaagtgttcgtccccaagaagaaatccgacatcaagtggtacggaaattacctcaacaacccgctaggacgcacggtgatgctaaccgtccagttcacgctcggctggcctttgtacttag

SEQ ID NO: 23928 - DNA, 355 bp, Artificial
  Mutation in BnaC.FAD2.b introduced by TALE nuclease pair BnFAD2_T02
cctctcctccctcaccctctcccttacctcgcctggcctctctactgcgcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtaccgcaacaacccgctaggacgcacggtgatgctaaccggccagttctcgcgcgtctggcctttgtacttag

SEQ ID NO: 23929 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactcgcggctggcctttgtacttag

SEQ ID NO: 23930 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgcagtgggcctcgtcttccactccttcctcctcgtcccttactaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23931 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23932 - DNA, 291 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23933 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaaatccgacatcaagtggtacgcaaagtacctcaacaaccctgtgggacgccccgtgatgttaacggttcagttcactctcggctggcctttgtacttag

SEQ ID NO: 23934 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcactctcggctggcctttgtacttag

SEQ ID NO: 23935 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctagtacgcacggtgatgctaaccgtccagttcacgctcggctggccttcgtacttag

SEQ ID NO: 23936 - DNA, 387 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggccccccagcaggtggtggccatcgccagcaatagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23937 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 23938 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttactcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23939 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaatgttccagattacgctatcgatatcgccggccatcgacgccaccattccaacaccggatccctcgagagggatgaagtgttcgtccccaagaagaaatccgacatcaagtggtacggaaattacctcaacaacccgctaggacgcacggtgatgctaaccgtccagttcacgctcggctggcctttgtacttag

SEQ ID NO: 23940 - DNA, 326 bp, Artificial
  Mutation in BnaC.FAD2.b introduced by TALE nuclease pair BnFAD2_T02
cctctcctccctcaccctctctcctacttcgcctggcctctctactgggcctgccatggctgcgtcctaaccggcgtctgggtcatagcccacgagtgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23941 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 23942 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcctctgggtcatcgcccacgaatgcggccaccacgccttcagcgaccaccagtggctggacgacgccgtgggcctcgtcttccactccttcctcctcgtcccttacttctcctggaccatcgacgccaccattccaacaccggatccctcgagagggatgaagtgttcgtccccaagaagaaatccgacatcaagtggtacggaaagtacctcaacaacccgctaggacgcacggtgatgctatccggccagttcacgctcggctggcctttgtacttag

SEQ ID NO: 23943 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctgtgtacttag

SEQ ID NO: 23944 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccgttgtacttag

SEQ ID NO: 23945 - DNA, 384 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacgccgaggcgacacacgaagcgatcgttggcgtcggcaaacacatcgacgccaccattccaacaccggatccctcgagagggatgaagtgttcgtccccaagaagaaatccgacagcaagtggtacggaaagtacctcaacaacccgctaggacgcgcggtgatgctaaccggccaggtcacgctcggctgcccttggtacttag

SEQ ID NO: 23946 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 23947 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctacccgtccagttcacgctcggctggcctttgtacttag

SEQ ID NO: 23948 - DNA, 357 bp, Artificial
  Mutation in BnaC.FAD2.b introduced by TALE nuclease pair BnFAD2_T02
cctctcctccctcaccctctaccttacctcgcctggcccctctactgggcctgacaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgccatcaagtggtacggaaagtacctcaacaacccgctaggacgcacggtgatgctaaccatccagttcacgctcggctggcctttgtacttag

SEQ ID NO: 23949 - DNA, 356 bp, Artificial
  Mutation in BnaC.FAD2.b introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgcgaggacgcacggtgatggtatccggccagttctcgcgcggcgggcctttgtacttag

SEQ ID NO: 23950 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccaaggatgcgtcctaacgggcgtctgggtcatcgcccacgaatgcggccaccacgccttcagcgaccaccagtggctggacgacgccgtaggcctcgtcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23951 - DNA, 335 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcaccattccaacactggctccctcgagagagacgaagtgtttgtccccaagaagaagtcagacatcaagtggtacggaaagtacctcaacaagccgctaggacggacggtgatgctgagcgttcagttcacgctcggctggcctttgtacttag

SEQ ID NO: 23952 - DNA, 356 bp, Artificial
  Mutation in BnaC.FAD2.b introduced by TALE nuclease pair BnFAD2_T02
cctctcctccctcaccctctcccttacctcgcctggcccctatactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaattcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 23953 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattcccacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 23954 - DNA, 343 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttgccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggcaggcctttgtgcttag

SEQ ID NO: 23955 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccggccaggtcacgctcgtctggcctttgtacttag

SEQ ID NO: 23956 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 23957 - DNA, 357 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 23958 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttagtccccaagaagaaatccgacatcaagtggtacggaaagtacctcaacaacccgctaggacgcacggtgatgctaaccgtccagttcacgctcggctggcctttgtacttag

SEQ ID NO: 23959 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 23960 - DNA, 356 bp, Artificial
  Mutation in BnaC.FAD2.b introduced by TALE nuclease pair BnFAD2_T02
cctctcctccctcaccctctaccttacctcgcctggatcctcttctgcgcctgccaaggctgcgtcctaacgggcctctgggtcatcgcccacgaatgcagccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtaccacaacaacccgctaggacgctcgggaatgctaaccgaccagttcacgctcggcgggccgttttccttag

SEQ ID NO: 23961 - DNA, 393 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatgttctttcctgcgttatcccctgattctgtggatatcgacgccaccattccaacaccggatccctcgagagggatgaagtgttcgtccccaagaagaaatccaacatcaagtggtacggaaagtacctcaacaacccgctaggacgcacggtgatgctaaccgtccagttcacgctcggctggcctttgtacttag

SEQ ID NO: 23962 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctgtgtacttag

SEQ ID NO: 23963 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaaggaccgcaacaacccgctaggacgcacggtggtgctaaccgcccagttcacgctcggctggcatttgtacttag

SEQ ID NO: 23964 - DNA, 357 bp, Artificial
  Mutation in BnaC.FAD2.b introduced by TALE nuclease pair BnFAD2_T02
cctctcctccctaaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23965 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 23966 - DNA, 394 bp, Artificial
  Mutation in BnaC.FAD2.b introduced by TALE nuclease pair BnFAD2_T02
cctctcctccctcaccctctcccttacctcgtctggctcctcttctgtgcctcccaaggccgcgcccacacggccctctgggtcatcgcccacgaatgcggccaccaccccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacagcaagtggtacggaaagtaccccaacaacccgcatgggcgcacggggatgctatccgtcccgttcacgctcggctggcctttgtacttag

SEQ ID NO: 23967 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggccggcctttgtacttag

SEQ ID NO: 23968 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcccaccattccaacaccggatccctcgatagggacgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 23969 - DNA, 319 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 23970 - DNA, 359 bp, Artificial
  Mutation in BnaC.FAD2.b introduced by TALE nuclease pair BnFAD2_T02
cctctcctccctcaccctctctcctacttcgcctggcctctctactggacctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23971 - DNA, 359 bp, Artificial
  Mutation in BnaC.FAD2.b introduced by TALE nuclease pair BnFAD2_T02
cctctgctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23972 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 23973 - DNA, 345 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctacgccaccattccaacaccggatccctcgagagggatgaagtgttcgtccccaagaagaaatccgacatcaagtggtacggaaagtacctcaacaacccgctaggacgcacggtgatgctaaccgtccaggtcacgtgcggctggcctttgtacttag

SEQ ID NO: 23974 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23975 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaggcacgccaccattccaacactggctccctcgagatagacgaagtgtttgtccccaagaagaaatccgacatcaagtggtacggcaagtacctcaacaaccctttgggacgcaccgtgatgttaacggttcagttcactctcggcgggcctttgtacttag

SEQ ID NO: 23976 - DNA, 351 bp, Artificial
  Mutation in BnaC.FAD2.b introduced by TALE nuclease pair BnFAD2_T02
cctctcctccctcaccctctctcctacttcgcctggcctctctcctgggcctgccaaggctgcgtcataacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23977 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctgtccttgttacttag

SEQ ID NO: 23978 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23979 - DNA, 357 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctagggcgcacggtgatgctaaccggccaggtctcggccggcgggcctttatacttag

SEQ ID NO: 23980 - DNA, 357 bp, Artificial
  Mutation in BnaC.FAD2.b introduced by TALE nuclease pair BnFAD2_T02
cctctcctccctcaccctctcccttacctcgcctgcagcctctactgggcctgccaaggctgcgtcctaacgggcctctgggtcatcgcccacgaatgcggccaccacgccttcagcgaccaccagtggctggactacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacggacggtgatgctaacagtccagttcacgcgcggctggcctttgtacttag

SEQ ID NO: 23981 - DNA, 359 bp, Artificial
  Mutation in BnaC.FAD2.b introduced by TALE nuclease pair BnFAD2_T02
cctctcctccctcaccctcttccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcgcggggatgctaaccgtccagttcacgctcggctgccctttgtacttag

SEQ ID NO: 23982 - DNA, 357 bp, Artificial
  Mutation in BnaC.FAD2.b introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctatccgtccagttcacgcgcgtctggcctttgtacttag

SEQ ID NO: 23983 - DNA, 354 bp, Artificial
  Mutation in BnaC.FAD2.b introduced by TALE nuclease pair BnFAD2_T02
cctctcctccctcaccctctgccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacatcgacgccaccattccaacactgcctccctcgagagagacgaagtgtttgtccccaagaagaagtcagacatcaagtggtacggcaagtacctcaacaacccgctaggacgcacggtgatgctaaccgtccagttcacgctcggctggcatttgtacttag

SEQ ID NO: 23984 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 23985 - DNA, 358 bp, Artificial
  Mutation in BnaC.FAD2.b introduced by TALE nuclease pair BnFAD2_T02
cctctcctccctcaccctctaccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgcgcggctggcctttgtacttag

SEQ ID NO: 23986 - DNA, 358 bp, Artificial
  Mutation in BnaC.FAD2.b introduced by TALE nuclease pair BnFAD2_T02
cctctcctccctcaccctctcccttacctcgcctggcccctctactgggcctgacaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaagccgacatcaagtggtacggaaaggtccgcagcgtccggtgagtatgagagatggtgctagccgcccaggtcgcgcgtgggtgccatgtgtacttag

SEQ ID NO: 23987 - DNA, 357 bp, Artificial
  Mutation in BnaC.FAD2.b introduced by TALE nuclease pair BnFAD2_T02
cctctcctccctcaccctctcccttacctcggctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23988 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtctttcactccttcctcctcgtcccttacttctcctggaagacaccatcgacgccaccattccaacaccggatccctcgagagggatgaagtgttcgtccccaagaagaaatccgacatcaagtggtacggaaagtacctcaacaacccgctaggacgcacgttgatgctaacctttcagttcacgctcggcgggcctttgtacttag

SEQ ID NO: 23989 - DNA, 357 bp, Artificial
  Mutation in BnaC.FAD2.b introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaaccctgtgggacgcaccgggatgttaacggttcagttcactcgcggctggcctttgtacttag

SEQ ID NO: 23990 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 23991 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacaacaagtggtacggaaagtacctcaacaacacgctaggacgcacggtgatgctaaccgtccagttcacgctcggctggcctttgtacttag

SEQ ID NO: 23992 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 23993 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggccggcctttgtacttag

SEQ ID NO: 23994 - DNA, 363 bp, Artificial
  Mutation in BnaC.FAD2.b introduced by TALE nuclease pair BnFAD2_T02
cctctcctccctcaccctctctcctacttcgcctggactctctactgggcctgccaagggtgcgtcctaaccggcgtctgggtcatagcccacgattgctgccaccacgccttcagccactaccagtggctggacgacaccgtcggcctcatcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgcgcggctggcctttgtacttag

SEQ ID NO: 23995 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtggtcctcgtcttccactccttcctcctcgtcccttacttctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23996 - DNA, 416 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatctccagcacctgcttgccgccatcgtggcccacggcttgacccccccgcgggtggtggcagtcatcgacgccaccattccaacaccggatccctcgagagggatgaagtgttcgtccccaagaagaagtcagacatcaagtggtacggcgaatacctcaacaaccctctgggacgcactgggatgttaacggttcagttcactcgcggctggcctttgtacttag

SEQ ID NO: 23997 - DNA, 359 bp, Artificial
  Mutation in BnaC.FAD2.b introduced by TALE nuclease pair BnFAD2_T02
cctctcctccctcaccctctcccttacctcgcctggcccctctactgagcctgccaaggctgcgtcctaacgagcctctgggtcttcgcccacgaatgcggccaccacgccttcagcgaccaccagtggctggacgacgccgtggacctcgtcttccactccttcctcctcgtcccttacttctccgggaagtagccatcgacgccaccattccaacaccggatccctcgagagggatgaagtgttcgtccccaagaagaaatccgacatcaagtggtacggaaagtacctcaacaacccgctgggacgcacggtgatgctaaccgtccagttcacgctcggctggcctttgtacttag

SEQ ID NO: 23998 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 23999 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggcagtcatcgacgccaccattccaacactggctccctcgagagagacgaagtgtttgtccccaagaagaaatccgacatcaagtggtacggaaagtacctcaacaacccgctaggacgcacggtgatgctaaccgtgcagttcacgctcggctggcctttgtacttag

SEQ ID NO: 24000 - DNA, 360 bp, Artificial
  Mutation in BnaC.FAD2.b introduced by TALE nuclease pair BnFAD2_T02
cctctcctccctcaccctctcccttacctcgcctggcccccctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24001 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 24002 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggagtctgggtcatagccaacgagtgcggccaccacgccttcagcgactaccagtggcttgacgacaccgtcggtctcatcttccactccttcctcctcgtcccttacttctcctggaagtatacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24003 - DNA, 357 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 24004 - DNA, 358 bp, Artificial
  Mutation in BnaC.FAD2.b introduced by TALE nuclease pair BnFAD2_T02
cctctcctccctcaccctctcccttacctcgcctggcacccctcatgggcctgacaaggctgcgtcctaacgggcctctgggtaatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgttcgtccccaagaagaagtcagacatcaagtggtacggcaaggtccgcaacaacccttggggacgcaccgtgatgttaacggtgcaggtcactcgcggccggcctgtgtacttag

SEQ ID NO: 24005 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24006 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacactggctccctcgagagggatgaagtgttcgtccccaagaagaaatccgacatcaagtggtacggaaagtgccacaacaacccgctaggacgcaaggtgatgctacccgtccagttcacgctcggctggcctttgtacttag

SEQ ID NO: 24007 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcccggctggcctttgtacttag

SEQ ID NO: 24008 - DNA, 362 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggcacggaaagtacctcaacaacccgctaggacgcacggtgatgctaaccgtccaggtcacgcgcggctggcctttgtacttag

SEQ ID NO: 24009 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacaccggatccctcgagagggatgaagtgttcgtccccaagaagaaagccgacatcaagtggtacggaaagtacctcaacaacccgctaggacgcacggtgatgctaaccgtccagttcacgctcggctggcctttgtacttag

SEQ ID NO: 24010 - DNA, 423 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccttacttctcctcgtcttccactccttcctcctcgtcccaatacagccatcgacgccaccattccaacaccggatccctcgagagggatgaagtgttcgtccccaagaagaaatccgacatcaagtggtacggaaagttcctcaacgcccggcgaggacgcgcggtggtgctagccgtgcatgtcgcgctcggctggcctttgtacgtag

SEQ ID NO: 24011 - DNA, 362 bp, Artificial
  Mutation in BnaC.FAD2.b introduced by TALE nuclease pair BnFAD2_T02
cctctcctccctcaccctctcccttacctcgcctgtctcctctactgcgcctgccaaggctgcgtcctaacgggcctctgggtaatcgcccacgaatgcggccaccacgccttcagcgaccaccagtggctggacgacgccgtgggcctcgtcttccactccctcctcctcgtcccttacttctcctggaaagtggctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24012 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24013 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 24014 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccgaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24015 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24016 - DNA, 355 bp, Artificial
  Mutation in BnaC.FAD2.b introduced by TALE nuclease pair BnFAD2_T02
cctctcctccctcaccctctatcctacttcgcctggcctctctaatgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24017 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgcgcggctggcctttgtacttag

SEQ ID NO: 24018 - DNA, 329 bp, Artificial
  Mutation in BnaC.FAD2.b introduced by TALE nuclease pair BnFAD2_T02
cctctcctccctcaccttttccttaccttgcctggcccctctactgggccttccaaagctgcgtcctaaagggcctctgggtcatcgcccacgaatgcggccaccacgccttcagcgaccaccaatggctggacgacaccgtcggtctcatcttccactccttcctcctcggcgccaccattccaacactggctccctcgagagagacgaagtgtttgtccccaagaagaaatccgacatcaagtggtacggcaagtacctcaacaacccgctaggacgcacggtgatgctaaccgtgcagttcactctcggcgggcctttgtacttag

SEQ ID NO: 24019 - DNA, 356 bp, Artificial
  Mutation in BnaC.FAD2.b introduced by TALE nuclease pair BnFAD2_T02
cctctcctccctcaccctctctcctacttcgcctggactctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctgtgggacgcgccggaaggttaacggtgcaggtcacttgcggcggcccttggtacttag

SEQ ID NO: 24020 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaagccgacatcaagtggtacggaaagtacctcaacaacccgctaggtcgcacggggatgctaaccttccagttcacgctcggctggcctttgtacttag

SEQ ID NO: 24021 - DNA, 357 bp, Artificial
  Mutation in BnaC.FAD2.b introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24022 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccaccaatgcggccaccacgccttcagcgaccaccagtggctggacgacgccgtgggcctcgtcttccactccttcctcctcgtcccttacttctgaagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24023 - DNA, 363 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccatcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24024 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgagtctaaccgtccagttcacgcgcggctggcctttgtacttag

SEQ ID NO: 24025 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtggctccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24026 - DNA, 357 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacgttgaggctaacggttcagttcactctcggcgggcctttgtacttag

SEQ ID NO: 24027 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24028 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 24029 - DNA, 343 bp, Artificial
  Mutation in BnaC.FAD2.b introduced by TALE nuclease pair BnFAD2_T02
cctctcctccctcaccctctcccttacctcgcctggatcctctactgggcctgccaaggacgcgtcctaacgggcctctgggtcatcgcccacgaatgcggccaccacgccttcagcgaccaccagtggctggacgacgccgtgggcctcgtcttccactccttcctcctcgtccctacttatcgacgccaccattccaacaccggatccctcgagagggatgaagtgttcgtccccaagaagaagtcagacatcaagtggtacggcaagtacctcaacaaccctttgggacgcaccgtgatgttaacggttcaggtcactctcgggtggcctttgtacttag

SEQ ID NO: 24030 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacaggcctctgggtcatcgcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24031 - DNA, 356 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgttcgtccccaagaagaaatccggcatcaagtggtacggaaagtacctcagcaacccgctaggacgcacggtgatgctaaccgtccagttcacgctcggccggccttagtacttag

SEQ ID NO: 24032 - DNA, 306 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24033 - DNA, 274 bp, Artificial
  Mutation in BnaC.FAD2.b introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgaccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggctggcctttgtacttag

SEQ ID NO: 24034 - DNA, 357 bp, Artificial
  Mutation in BnaC.FAD2.b introduced by TALE nuclease pair BnFAD2_T02
cctctcctccctcaccctctaccttacctcgcctggcccccatactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24035 - DNA, 356 bp, Artificial
  Mutation in BnaC.FAD2.b introduced by TALE nuclease pair BnFAD2_T02
cctctcctccctcaccctctctcctacttcgcctggcatctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaagccgacatcaagtggtacggaaagtgcctcaacaacccgctaggacgcacggtgaggctaaccgtccagttcactcgcggctggccttagtacttag

SEQ ID NO: 24036 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24037 - DNA, 400 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaccgcctctccccgcgcgttggcacgacaggtttcccgacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 24038 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24039 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24040 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccattgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24041 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttccccctcgtcccttacttctcctggaagttatcagccatcgacgccaccattccaacaccggatccctcgagagggatgaagtgttcgtccccaagaagaaatccgacatcaagtggtacggaaagtacctcaacaacccgctaggacgcgcggtgatgctaaccgtccaggtcacgctcggctggcctttgtacttag

SEQ ID NO: 24042 - DNA, 357 bp, Artificial
  Mutation in BnaC.FAD2.b introduced by TALE nuclease pair BnFAD2_T02
cctctcctccctcaccctctgccttacctcgtctggcccctctcctgagcctgccaaggctgcgtcctaacgggcctctgggtcatcgcccacgaatgctgccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggtgcagttcactcgcggctggcctgtgtacttag

SEQ ID NO: 24043 - DNA, 357 bp, Artificial
  Mutation in BnaC.FAD2.b introduced by TALE nuclease pair BnFAD2_T02
cctctcctccctcaccctctctcctacttcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacacaggatccctcgagagggatgaagtgttcgtccccaagaagaaatccgacatcaagtggtacggaaagtaccgcaacaacccgctaggacgcacggtgatgctaaccgtccagttcacgctcggctggcctttgtacttag

SEQ ID NO: 24044 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctacccgtccagttcacgctcggctggcctttgtacttag

SEQ ID NO: 24045 - DNA, 344 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24046 - DNA, 354 bp, Artificial
  Mutation in BnaC.FAD2.b introduced by TALE nuclease pair BnFAD2_T02
cctctcctccctcaccctctctcctacttcgcctggcctctctactgggcctgacaagggtgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24047 - DNA, 358 bp, Artificial
  Mutation in BnaC.FAD2.b introduced by TALE nuclease pair BnFAD2_T02
cctctcctccctcaccctctcccctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttagtccccaagaagaaatccgacatcaagtggtacggaaagtacctcaacaacccgctaggacgcacggtgatgctaaccgtccagttcacgctcggctggcctttgtacttag

SEQ ID NO: 24048 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggccatcgacgccaccattccaacactggctccctcgagagagacgaagtgttcgtccccaagaagaaatccgacatcaagtggtacggaaagtacctcaacaacccgctaggacgcacgttgagtctaaccgtccagttcacgctcggcgggcctttgtacttag

SEQ ID NO: 24049 - DNA, 413 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggcacagcaccggcaacagcgcctgcaccgtctccagcgcctgcttgccaccaatatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24050 - DNA, 357 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgcggtgggcctcgtcttccactccttcctcctcgtcccttacttctcctggaaagccatcgacgccaccattccaacaccggatacctcgagagggatgaagtgttcgtccccaagaagaagtcaaacatcaaggggtacggcgaggacctcaacaacccgttgggacgcaccgggatgttaacggttcaggtcactcgcggctggccttagtacttag

SEQ ID NO: 24051 - DNA, 395 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggcacagcaccggcaacagccgctggaccgtctccagcgcctgcttgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24052 - DNA, 408 bp, Artificial
  Mutation in BnaC.FAD2.b introduced by TALE nuclease pair BnFAD2_T02
cctctcctccctcaccctctcccttacctcgcctggcccctctctcgagcctgccaaggatgcgtcccaacgagcctctgggtcatcgcccacgaatgcggccaccacgccttcagcgaccaccagtggctggacgacaccgtcggcctcctcttccactccttcctcctcgtcccttacttctcctggaagttctccagcgcctgcttgccgccatcgtgactggcgatggccaccacctgagccatcgacgccaccattccaacaccggatccctcgagagggattaagtgttcgtccccaagaagaagtcagacatcaagtggtacggcaagtacctcaacgacccttttggacgcaccgtgagtttaacggttcgggtcactctcggctggcctttgtgcttag

SEQ ID NO: 24053 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaaaacccgctaggacgcacggtgatgctaaccgtccagttcacgctcggctggcctttgtacttag

SEQ ID NO: 24054 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacgccaccattccaacaccggatccctcgagagggatgaagtgttcgtccccaagaagaagtcagacatcaagtggtacggcaagtacctcaacaacccttggggacgcaccgtgaggttaacggttcagttcactctcggctggcctttgtacttag

SEQ ID NO: 24055 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatcctaaccgtccagttcacgctcggcgggcctttgtacttg

SEQ ID NO: 24056 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcatccccaagaagaagtcagacatcaagtggtacggcaagtacctcaacaacccgttgggacgcacggtgatgttaacggttcagttcactctcggctggcctttgtacttag

SEQ ID NO: 24057 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 24058 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaagtcagacatcaagtggtacggcaagtacctcaacaaccctttgggacgcaccgtgatggtaacggttcagttcactctcggctggcctttgtacttag

SEQ ID NO: 24059 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24060 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24061 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24062 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 24063 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttcccctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24064 - DNA, 356 bp, Artificial
  Mutation in BnaC.FAD2.b introduced by TALE nuclease pair BnFAD2_T02
cctctcctccctcaccctctctcctacttcgcctggcatctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgccctttgtacttag

SEQ ID NO: 24065 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24066 - DNA, 337 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24067 - DNA, 355 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24068 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24069 - DNA, 357 bp, Artificial
  Mutation in BnaC.FAD2.b introduced by TALE nuclease pair BnFAD2_T02
cctctcctccctcaccctctcccttacctcgcctggcccctataatgggcctgccaaggctgcgtcctaacgggcctctgggtcatcgcccacgaatgcggccaccacgccttcagcgaccaccagtggctggacgacgccgtgggcctcgtcttccactccttcctcctcgtcccatacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24070 - DNA, 362 bp, Artificial
  Mutation in BnaC.FAD2.b introduced by TALE nuclease pair BnFAD2_T02
cctctcctccctcaccctctcccttacctcacctggcccctctactgggcctgccaaggctgcgtcctaacgggcctctgggtcatcgcccacgagtgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaacccgctatgacgcacggtgatgctaaccgtccagttcacgctcggctggcctttgtacttag

SEQ ID NO: 24071 - DNA, 273 bp, Artificial
  Mutation in BnaC.FAD2.b introduced by TALE nuclease pair BnFAD2_T02
cctctcctcactcaccctctcccttacctcgcctggcacatctaatgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggcaagtacctcaacaaccctttgggacgcaccgtgatgttaacgtttcagttcactttcggctggcctttgtacttag

SEQ ID NO: 24072 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccaccccttcagcgaccaccagtggctggacgacgccgtgggcctcgtcttccactccttcctcctcgtcccttacttctcctggaaagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24073 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacgtag

SEQ ID NO: 24074 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgcgcggctgcccttagtacttag

SEQ ID NO: 24075 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24076 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24077 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggattaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24078 - DNA, 435 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttggacacaggccaacttctcaagattgcaaaacgtggcggcgtgaccgcagtggaggcagtgcatgcatggcgtacagccatcgacgccaccattccaacaccggatccctcgagagggatgaagtgttcgtccccaagaagaaatccgacatcaagtggtacggaaagtacctcaacaagccgctaggacgcacggttatgctaaccgtccagttcacgctcggctggcctttgtactgag

SEQ ID NO: 24079 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24080 - DNA, 292 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccattccaacactggctccctcgagagggatgaagtgttcgtccccaagaagaaatccgacatcaagtggtacggaaagtacctcaacaacccgctaggacgcacggtgatgctaaccgtccagttcacgctcggcttggcctttgtacttag

SEQ ID NO: 24081 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 24082 - DNA, 355 bp, Artificial
  Mutation in BnaC.FAD2.b introduced by TALE nuclease pair BnFAD2_T02
cctctcctccctcaccctctcccttacctcgcctggcccctatactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccatcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24083 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24084 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttaa

SEQ ID NO: 24085 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24086 - DNA, 324 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgaccccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttac

SEQ ID NO: 24087 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccacgaagaaatccgccatcaagtggtacggaaagtacctcaacaacccgctaaaacgcacggtgatgctcaccgtccagttcacgcccggctggcctttgtacttag

SEQ ID NO: 24088 - DNA, 372 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcaagtcagaggtggcgaaacccgacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24089 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgtcaccgtcggcctcatcttccactccttcctcctcgtcccttacttctccttgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24090 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgatagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24091 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24092 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcctcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24093 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24094 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctaaacaacccgctaggacgcacgatgatgctaaccgtccagttcccgctcggctggcctttgtacttag

SEQ ID NO: 24095 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttgagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24096 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttaa

SEQ ID NO: 24097 - DNA, 319 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaacccgataggacgcacggtgatgctaaccgtccagttcacgctcggctggcctttgtactcag

SEQ ID NO: 24098 - DNA, 326 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24099 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcatcctcgtcccttacttctcctggaaagccatcgacgccaccattccaacaccggatccctcgagagggatgaagtgttcgtccccaagaagaaagccgacatcaagtggtacggaaagtacctcaacaacccgctaggacgcacggtgatgctaaccgtccatttcacgctcgtctggcctttgtacttag

SEQ ID NO: 24100 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcgagtggtacggaaagtacctcaacaacccgctaggacgcacggtgatgctaaccgtccagttcacgcgcggctggcctttgtacgtag

SEQ ID NO: 24101 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgatcggctggcctttgtacttag

SEQ ID NO: 24102 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24103 - DNA, 448 bp, Artificial
  Mutation in BnaC.FAD2.b introduced by TALE nuclease pair BnFAD2_T02
cctctcctccatcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccgtggcggcgtgaccgcagtggaggcagtgcatgcatggcgccgatctacgcacgctcggctacagccagcagcaacaggagaagatcaaaccgaaggttcatcgacgccaccattccaacaccggatccatcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24104 - DNA, 365 bp, Artificial
  Mutation in BnaC.FAD2.b introduced by TALE nuclease pair BnFAD2_T02
cctctcctccctcaccctctcccttacctcgtctggttcctttactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaacagccatcgacgccaccattccaacaccggatccctcgagagggatgaagtgttcgtccccaagaagaaatccgacatcaagtggtacggaaagtacctcaacgagccgctagggcgcacgatgatgctaaccgtccagtacacgctcggctggcctttgtacttag

SEQ ID NO: 24105 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagtgatgaagtgttcgtccccaagaagaaatccgacatcaagtggtacggaaagtacctcaacaaccctctaggacgcacggtgatgttaacggttcagttcactctcggctggcctttgtacttag

SEQ ID NO: 24106 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggccatcgacgccaccattccaacaccggatccctcgagagggatgaagtgttcgtccccaagaagaaatccgacagcaagtggtacggaaagtacctcaacaacccgctaggacgcacggtgatgctaaccgtccagttcacgctcggctggccttggtacttag

SEQ ID NO: 24107 - DNA, 359 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgccctttgtacttat

SEQ ID NO: 24108 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcatttgtacttag

SEQ ID NO: 24109 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgccttccactccttcttccacagccatcgacgccaccattccaccaccggatccctctagagggatgaagtgttcgtccccaagaagaaatccgacagcaagtggtacggaaagtacctcaacaacccgctaggacgcacggtgatgctaaccgtccagttcacgcgcggctggccttagtacttac

SEQ ID NO: 24110 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactacttcctcctcgtcccttacttctcctggaagtcatcgacgccaccattccaacaccggatccctcgagagggatgaagtgttcgtccccaagaagaaatcccacatcaagtggtacggaaagtacctcaacaacccgctaggacgcacggtgatgctaaccgtccagttcacgctcggctggcctttgtacttat

SEQ ID NO: 24111 - DNA, 355 bp, Artificial
  Mutation in BnaC.FAD2.b introduced by TALE nuclease pair BnFAD2_T02
cctctcctccctcaccctctctcctacttcgcctggcctctatactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24112 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24113 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtcccaaagaagaaatccgacatcaagtggtacggaaagtacctcaacaacccgctaggacgcacggtgatgctaaccgtccagttcacgctcggctggcctttgtacttag

SEQ ID NO: 24114 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccatggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24115 - DNA, 408 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatatttggattgagagtgaatatgagactctaattggataccgaggggaatttgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24116 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24117 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtactaacgggcctctgggtcatcgcccacgaatgcggccaccacgccttcagcgaccaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24118 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24119 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgatcggctggcctttgtacttag

SEQ ID NO: 24120 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgctgccaccacgccttcagcgactaccagtgacttgacgacaccgtcggtctcatcttccactccttcctcctcgtcccttacttctcctggaaagccatcgacgcctccattccaacaccggagccctcgagagggatgaagtgttcgtccccaagaagaaatccgacatcaagtggtacggaaagtacctcaacaacccgctaggacgcacggtgaggctaaccgtccagttcacgctcggctggcctttgtgcttac

SEQ ID NO: 24121 - DNA, 413 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacaggcccacggcttgaccccccagcaggtggtggccatcgccagcaatggcgatggcagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24122 - DNA, 370 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgacttcagcgactaccagtggcttgacgacaccgtcggtctcatcttccactccttacttactcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24123 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24124 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttat

SEQ ID NO: 24125 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24126 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacgccgtgggcctcgtcttccactccttcctcctcgtcccttacttctcctggaaacatcgacgccaccattccaacactggctccctcgagagagacgaagtgtttgtccccaagaagaagtcagacatcaagtagtacggcaagtacctcaacaacccgctaggacgcacggtgatgctaaccgtccagttcacgctcggctggcctttgtacttag

SEQ ID NO: 24127 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24128 - DNA, 388 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcaataatggtggcaagcaggcgctggatccaagaagaaatccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24129 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24130 - DNA, 401 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtactgcccgctttccagtcgggaaacctgtcgtgccagctgcaagccatcgacgccaccattccaacaccggatccctcgagagggatgaagtgttcgtccccaagaagaaatccgacatcaagtggtacggaaagtacctcaacagcccgctaggacgcacggtgatgctaaccggccagttcacgctcggctggcctttgtacttag

SEQ ID NO: 24131 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctaacaacccgctaggacgcacggtgatgctaaccgtccagttcacgctcggctggcctttgtacttag

SEQ ID NO: 24132 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagggccatcgacgccaccattcccacaccggatccctcgagagggatgaagtgttcgtccccaagaagaaatccgacatcaagtggtacggaaagtacctcaacaacccgctagaacgcacggtgatgctaaccgtccagttcacgctcggctggcctttgtacttag

SEQ ID NO: 24133 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24134 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24135 - DNA, 334 bp, Artificial
  Mutation in BnaC.FAD2.b introduced by TALE nuclease pair BnFAD2_T02
ccctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24136 - DNA, 354 bp, Artificial
  Mutation in BnaC.FAD2.b introduced by TALE nuclease pair BnFAD2_T02
cctctcctccccaccctctcccttacctcgcctggcccctctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24137 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctcccaccattccaacaccggatccctcgatagggacgaagtgttcgtccacaagaagaaatccgacatcaagtggtacggcaagtacctcaacaacccgctaggacgcacggtgatgctaaccgtccagttcaagctcggctggcctttgtacttag

SEQ ID NO: 24138 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaccatgacgccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttaa

SEQ ID NO: 24139 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtacttag

SEQ ID NO: 24140 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcgcttacttctcctggaaagccatcgacgccaccattccaacaccggatccctcgagagggatgaagtgttcgtccccaagaagaaatccgacatcaagtggtacgcaaagtacctcaacaacccgctaggacgcacggtgatgctaaccgtccagttcacgctcggctggcctttgtgcttag

SEQ ID NO: 24141 - DNA, 349 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24142 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattcctacaccggatccctcgggagggatgaagtgttcgtccccaagaagaagtccgacatcaactggtacggcaagtacctcaacaaccctttgggacgcaccgtgatgttaacggttcaggtcactctcggctgccctttgtacttag

SEQ ID NO: 24143 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcgcggtggtgctaaccgtgcagttcacgcgcggctggcctttgtacttag

SEQ ID NO: 24144 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 24145 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacaaatgcggcccccacgccatcgacgccaccattccaccaccggatccctcgagagggatgaagtgttcgtccccaagaagaaatccgacatcaagtggtacggaaagtacctcaacaacccgctaggacgcacggtgatgctaaccgtccagttcacgctcgacttgcctttgtacttat

SEQ ID NO: 24146 - DNA, 274 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggcaagtacctcaacaaccctttgggacgcacggtgatgctaaccgtccagttcacgctcggctggcctttgtacttag

SEQ ID NO: 24147 - DNA, 355 bp, Artificial
  Mutation in BnaC.FAD2.b introduced by TALE nuclease pair BnFAD2_T02
cctctcctccctcacctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacaccggatccctcgagagggatgaagtgttcgtccccaggaagaaatccgacatcaagtggtacggaaagtacctcaacaacccgctaggacgcacggtgatgctaaccgtccagttcacgctcggctggcctttgtacttag

SEQ ID NO: 24148 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcatgtggtacggcaagtacctcaacaaccctttgggacgcaccgtgatgttaacggttcagttcactctcggctggcctttgtacttag

SEQ ID NO: 24149 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24150 - DNA, 354 bp, Artificial
  Mutation in BnaC.FAD2.b introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24151 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaacggcgagctttgatcaacgaccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24152 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24153 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacagcccgctatgacgaacggtgaggctaaccgtccagttcacgctcggctggcctttgtacttag

SEQ ID NO: 24154 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgtgcctctgggtcatcgcccacgaatgcggccaccacgccttcagcgaccaccagtggctggacgacgccgtgggcctcgtcttccactccttcctcctcgtcccttacttctcctggaagtcaataatggtggcaagcgggcgctggatccatcgacgccaccattccaacaccggatccctcgagagggatgaagtgttcgtccccaagaagaaatccgccatcaagtggtacggaaagtacctcaacaacccgctaggacgcacggtgatgctaaccgtccagttcacgcttggctgccctttgtacttag

SEQ ID NO: 24155 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 24156 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcatgctcggttggcctttgtacttag

SEQ ID NO: 24157 - DNA, 395 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgaccccccagcaggtggtggccatcgccagccaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24158 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggccgacgccgtgggcctcgtcttccactccttcctcctcgtcccttacttctcctggaagtacccagccatcgacgccaccattccaacaccgggtccctcgagagggatgaagggttcgtccccaagaagaaatccgacatcaagtggtacggcaagtacctcaacacccctttgggacgcaccgtgatgttaacggttcagttcactctcggctggcctttgtacttag

SEQ ID NO: 24159 - DNA, 422 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcaggtggtggccatcgccagccacgatggcggcaagcaggcgctggagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24160 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaagggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24161 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 24162 - DNA, 312 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24163 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtgcttag

SEQ ID NO: 24164 - DNA, 351 bp, Artificial
  Mutation in BnaC.FAD2.b introduced by TALE nuclease pair BnFAD2_T02
cctctcctccctcaccctctcccttacctcgcctggcttctctactgggcctgccagggctgcgccctaaccggcgtctgggccacagcccacgagtgcggccaccacgccttctgcgaccaccagtggctggacgacgccgcgggcctcgtcttccactccttcctcctcgtcccttacttctcctgcatcgacgccaccattccaacaccggatccctcgagagggatgaagtgttcgtccccaagaagaaatccgacatcaagtggtacggaaagtacctcagcaacccgctaggacgcacggtgggtcaaaccgtccgagtcacgctcggctgcccttagcacttac

SEQ ID NO: 24165 - DNA, 343 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24166 - DNA, 355 bp, Artificial
  Mutation in BnaC.FAD2.b introduced by TALE nuclease pair BnFAD2_T02
cctctcctcctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24167 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24168 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggacatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24169 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcaaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 24170 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaaatccgacatcaagtggtacggaaaggacctcaacaacccgctaggacgcacggtgatgctaaccgtccagttcacgcgcggctggcctttgtacttag

SEQ ID NO: 24171 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24172 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24173 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24174 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 24175 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgcgcggctggcctttgtacgtag

SEQ ID NO: 24176 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattcccacaccggatccctcgagagggatgaagtgttcgtccccaagaagaaatccgacatcaagtggtacggaaagtacctcaacaacccgctaggacgcacggtgatgctaaccgtccagttcacgctcggctggcatttgtacttag

SEQ ID NO: 24177 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaagccgacatcaagtggtacggaaagtacctcaacaacccgctaggacgcacggtgaggctaaccgtccagttcacgctcggctggcctttgtacttag

SEQ ID NO: 24178 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgcacttag

SEQ ID NO: 24179 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagggttcgtccccaagaagaaatccgacatcaagtggtacggaaagtacctcaacaacccgctaggacgcacggtgatgctaaccgtccagttcacgctcggctggcctttgtacttag

SEQ ID NO: 24180 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacacaggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24181 - DNA, 357 bp, Artificial
  Mutation in BnaC.FAD2.b introduced by TALE nuclease pair BnFAD2_T02
cctctcctccctcaccctctcccttacctcgcctggcccctctactgtgcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24182 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcatctgggtcatcgcccacgaatgcggccaccatgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24183 - DNA, 357 bp, Artificial
  Mutation in BnaC.FAD2.b introduced by TALE nuclease pair BnFAD2_T02
cctctcctccctcaccctctctcctacttcgcctggcctctctaatgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggggatgctaaccgtccatgtcacgctcggctggcctgtgtacttag

SEQ ID NO: 24184 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24185 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctatgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgtttgtccccaagaagaaatccgacatcaagtggtacggaaagtacctcaacaacccgcgaggacgcacggtgatgctaaccttccaggtcacgctcggctggcctttgtacttag

SEQ ID NO: 24186 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24187 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 24188 - DNA, 367 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtacacacacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24189 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24190 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24191 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaagtcagacatcaagtggtacggcaagtacctcaacaaccctgtgggacgcaccgtgatgttaacggtgcagttcactctcggctggcctttgtacttag

SEQ ID NO: 24192 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24193 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcacttacttctcctggaacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24194 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactcattcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttat

SEQ ID NO: 24195 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 24196 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctgccctttgtacttag

SEQ ID NO: 24197 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgccaacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24198 - DNA, 385 bp, Artificial
  Mutation in BnaC.FAD2.b introduced by TALE nuclease pair BnFAD2_T02
cctctcctccatcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcaataatggtggcaagcaggcgctggatccatcgacgccaccattccaacaccggatccctcgcgagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24199 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactcgcggctggcctttgtacttag

SEQ ID NO: 24200 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 24201 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24202 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacagtcatcgacgccaccattccaacaccggatccctcgagagggatgaagtgttcgtccccaagaagaaatccgacatcaagtggtacggaaagtacctcaacaacccgctaggacgcacggtgatgctaaccttccatttcacgcgcggctggccttagtacttag

SEQ ID NO: 24203 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24204 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcgcctggcctttgtacttag

SEQ ID NO: 24205 - DNA, 394 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24206 - DNA, 384 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacgccgaggcgacacacgaagcgatcgttggcgtcggcaaacacatcgacgccaccattccaacaccggatccctcgagagggatgaagtgttcgtccccaagaagaaatccgacatcaagtggtacggaaagtacctcaacgacccgctagggcgcacggtgatgctaaccgtccagttcacgctcggctggcctttgtacttag

SEQ ID NO: 24207 - DNA, 352 bp, Artificial
  Mutation in BnaC.FAD2.b introduced by TALE nuclease pair BnFAD2_T02
cctctcctccctcaccctctaccttacctcgcctggcctctctactgcgcctgccagggctgcgtcctaaccggcgtctgggtcatagcccacgagtgcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcgtgtggcctttgtgcttag

SEQ ID NO: 24208 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccacaccttcctcctcgtcccaatacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 24209 - DNA, 362 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtgggcctcgtcttccactccttcctcctcgtcccttacttctcctggaaagtggctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24210 - DNA, 435 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttggacacaggccaacttctcaagattgcaaaacgtggcggcgtgaccgcagtggaggcagtgcatgcatggcgtacagccatcgacgccaccattccaacaccggatccctcgagagggatgaagtgttcgaccccaagaagaaatccgacatcaagtggtacggaaagtacctcaacaacccgctaggacgcacggtgaggctaaccgcccaggtcacgctcggctggcctttgtacttag

SEQ ID NO: 24211 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtactttag

SEQ ID NO: 24212 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgccatcaagtggtacggaaagtaccgcaacaacccgctaggacgcagggtgatgctaaccgtccatttcacgctcggctgcccttggttcttag

SEQ ID NO: 24213 - DNA, 353 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgtcatagcccacgagtgcggccaccacgccttcagcgactaccagtggcttgacgacaccgtcggtctcatcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24214 - DNA, 357 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccactattccaacactggctccctcgagagagacgaagtgtttgtccccaagaagaagtcagacatcaagtggtacggaaaggaccgcaacaacccggtaggacgcacggggatgctaaccgtccagttcacgctcggctggcctttgtacttag

SEQ ID NO: 24215 - DNA, 393 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtacaacactggctccctcgagagagacgaagtgtttgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24216 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24217 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagagacgaagtgtttgtccccaagaagaagtcagacatcaagtggtacggcaagtacctcaacaaccctgtgggacgcaccgtgatgttaacggttcagttcactctcggctggcctgtgtacttag

SEQ ID NO: 24218 - DNA, 406 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtactccagcgcctgcttgccaccattattgctggcgatggccaccacctgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 24219 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattacaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 24220 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaaccctttgggacgcaccgtgatgttaacggtgcaggtcactctcggctggcctttgtacttag

SEQ ID NO: 24221 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24222 - DNA, 315 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgccctaccgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctgaacgacccgctagggcggacggggatgctgaccggccagttcacgctcggctggccttagtacttag

SEQ ID NO: 24223 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24224 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24225 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 24226 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcacgctcggctggccttggtacttag

SEQ ID NO: 24227 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctgtgtacttag

SEQ ID NO: 24228 - DNA, 431 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaacattgctggcgatggccaccacctgctggggggtcaagccgtgggcctggcacagcaccggcaacagccgctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24229 - DNA, 359 bp, Artificial
  Mutation in BnaC.FAD2.b introduced by TALE nuclease pair BnFAD2_T02
cctctcctccctcaccctctcccttacctcgcctggcccctctacttggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 24230 - DNA, 408 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcctttcgttttaattgatgcctggcagttccctattctcgtgttgaatacagccatcgacgccaccattccaacaccggatccctcgagagggatgaagtgttcgtccccaagaagaaatccgacataaagtggtacggaaagtacctcaacaacccgctaggacgcacggggatgctaaccgtccaggtcacgctcggctggcctgtgtacttag

SEQ ID NO: 24231 - DNA, 369 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtggacctcgtcttccactccttcctcctcgccccctacaacctgcccatcggccaggccgacgccatcgacgccaccattccaacaccggatccctcgagagggatgaagtgttcgtccccaagaagaagtcagacatcaagtggtacggcgagtacctcaacaaccctttggaacgcaccgtgatgttaacggttcagttcactctcggctggccttagtacttag

SEQ ID NO: 24232 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgcacttag

SEQ ID NO: 24233 - DNA, 341 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccagtcatcgacgccaccattccaacactggctccctcgagagagacgaagtgtttgtccccaagaagaagtcagacatcaagtggtacggcaagtacctcaacaaccctgtgggacgcacggtgatgctaaccgtccagttcacgctcggctggccttggtacttag

SEQ ID NO: 24234 - DNA, 341 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 24235 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcgtctgggtcatagcccacgagtgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24236 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24237 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24238 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 24239 - DNA, 358 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacaccaagtggtacggaaagtacctcaacaacccgctaggacgcacggggatgctaaccgtccagttcacgctcggctggcctttgtacttag

SEQ ID NO: 24240 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 24241 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 24242 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtacttag

SEQ ID NO: 24243 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaagacgcacggtgatgctaaccgtccagttcacgctcggctggcctttgtacttag

SEQ ID NO: 24244 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctctagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24245 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24246 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggggatgctaaccgtccaggtcacgcgcggctggccttagtacttag

SEQ ID NO: 24247 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24248 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacaccggatccctcgagagggatgaagtgttcgtccccaagaagaaagccgacatcaagtggtacggaaagtacctcaacaacccgctaggacgcacggtgatgctaaccgtccagttcacgctcggctggcctttgtacttag

SEQ ID NO: 24249 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggattaagtgttcgtccccaagaagaaatccgacatcaagtggtacggaaagtacctcaacaacccgctaggacgcacggtgatgctagccggccatttctcgcgcgaggggcctttgtacttag

SEQ ID NO: 24250 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24251 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcgcctggcatttgtacttag

SEQ ID NO: 24252 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgttcgtccccaagaagaaagccgacatcaagtggtacggaaagtacctcaacaacccgctaggacgcacggtgatgctaaccgtccagttcacgctcggctggcctttgtacttag

SEQ ID NO: 24253 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctcttggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24254 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 24255 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24256 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcggcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24257 - DNA, 324 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagtgatgaagtgttcgtccccaagaggaaatccgacatcaagtggtacggaaagtacctcaacaacccgctaggacgcacggtgaggctaaccgtccagttcacgctcggctggcctttgtacttag

SEQ ID NO: 24258 - DNA, 384 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacgccgaggcgacacacgaagcgatcgttggcgtcggcaaacacatcgacgccaccattccaacaccggatccctcgagagggatgaagtgttcgtccccaagaataaatccgacatcaagtggtacggaaagtacctcaacaacccgctaggacgcacggtgatgctatccgtccagttctcgcgcggctggcctttgtacttag

SEQ ID NO: 24259 - DNA, 357 bp, Artificial
  Mutation in BnaC.FAD2.b introduced by TALE nuclease pair BnFAD2_T02
cctctcctccctcaccctctcccttacctcgcctggcccccctcatgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctccaggaagttcatcgacgccaccattccaacactggctccctcgagagagacgaagggtttgtccccaagaagaaatccgacatcaagtggtacggaaagtacctcaacaacccgctaggacgcacggtgatgctaaccttccatgtcacgcgcgggtggcctttgtacttag

SEQ ID NO: 24260 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 24261 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcatggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24262 - DNA, 291 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgccaccattccaacactggctccctcgagagggatgaagtgttcgtccccaagaagaaatccgacatcaagtggtacggaaagtacctcaacaacccgctaggacgcacggtgatgctaaccttccagttcacgctcggctggcctgtgtacttag

SEQ ID NO: 24263 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctatccgtccagttctcgctcggctgccctttgtacttag

SEQ ID NO: 24264 - DNA, 342 bp, Artificial
  Mutation in BnaC.FAD2.b introduced by TALE nuclease pair BnFAD2_T02
cctctcctccctcaccctctcccttacctcgcctgtcccctctactgggcctgccaaggctgcgtcctcacgggcctctgggtcatcgcccacgaatgcggccaccacgccttcagcgaccaccagtggctggacgacgccgtgggcctcgtcttccactccttcctcctcgtcccttacttctcctggaagtaccggataccggatccctcgagagggatgaagtgttcgtccccaagaagaaatccgacatcaagtggtacggaaaggacctcaacaacccgctaggacgcacggtgatgctaaccgtccagttcacgctcggctggcctttgtacttag

SEQ ID NO: 24265 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 24266 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctgggcgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 24267 - DNA, 357 bp, Artificial
  Mutation in BnaC.FAD2.b introduced by TALE nuclease pair BnFAD2_T02
cctctcctccctcaccctctcccttacctcacctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24268 - DNA, 357 bp, Artificial
  Mutation in BnaC.FAD2.b introduced by TALE nuclease pair BnFAD2_T02
cctctcctccctcaccctctcccttatctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24269 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24270 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagacatcgacgccaccattccaacactggctccctcgagagagacgaagtgttcgtccccaagaagaaatccgacatcaagtggtacggaaagtacctcaacaacccgctaggacgcacggggatgctaaccgtccaggtcacgcgcggctggcctgtgtacttag

SEQ ID NO: 24271 - DNA, 367 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacacacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24272 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgctcgtccccaagaagaaatccgacatcaagtggtacggaaagtacctcaacaacccgctaggacgcacggtgatgctaaccgtccagttcacgctcggctggcctttgtacttag

SEQ ID NO: 24273 - DNA, 403 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagcaagatcgcttggcctcgcgcgcagatcagttggaagaatttgtccgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24274 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaattcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24275 - DNA, 333 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 24276 - DNA, 412 bp, Artificial
  Mutation in BnaC.FAD2.b introduced by TALE nuclease pair BnFAD2_T02
cctcttctccctcaccctctcccttacctcgcctggctcctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctgaaccacatcaccaactgcaacggcgccgtgctgtccgtggaggagctccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtgcttag

SEQ ID NO: 24277 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggaaagtacctcaacaacccactaggacgcacggtgatgctaaccgtccagttcacgctcggctggcctttgtacttag

SEQ ID NO: 24278 - DNA, 359 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcaccgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcgcggtgatgctaaccgtcccgttcacgcccggctggcctttgtacttag

SEQ ID NO: 24279 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcatttcacactcggctggcctgagtacttag

SEQ ID NO: 24280 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24281 - DNA, 357 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggccttggtacttag

SEQ ID NO: 24282 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24283 - DNA, 358 bp, Artificial
  Mutation in BnaC.FAD2.b introduced by TALE nuclease pair BnFAD2_T02
cctctccttcctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgccctttgtacttag

SEQ ID NO: 24284 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgttcgtccccaagaagaaatccgacatcaagtggtacggaaagtacctcaccaacccgctaggacgcacggggatgctaaccgtccatttcacgctcggctggcctttgtacttag

SEQ ID NO: 24285 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaattacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 24286 - DNA, 355 bp, Artificial
  Mutation in BnaC.FAD2.b introduced by TALE nuclease pair BnFAD2_T02
cctctcctccctcaccctctcccttccttcgcctgtcccctcttctgggcctgcccaggctgcgtcctaacggggctctgggtcctcgcgcccgcatgcggccaccacgccttcagcgaccaccagtggctggacgacgccgtgcgcctcgtcttccactccttcctcctcgtcccttacttctcctggagccatcgacgccaccattccaacaccggatccctcgagagggatgaagtgttcgtccccaagaagaagtcagacatcaagtgctacggcaagtacctcaacaagcgttgggtgcgcaccatggtgttaacggttcagttcactctcggctggcctttgtacttag

SEQ ID NO: 24287 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtacctcaacaaccctttgggacgcaccgggatgttaacggttcagttcactctcggttgtcctttgtacttag

SEQ ID NO: 24288 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgtttgtccccaagaagaaatcccacatcaagtggtacggaaagtacctcaacaacccgctaggacgcacgttggtgctaaccgcccagttcaggctgggctgccctttgtgcttag

SEQ ID NO: 24289 - DNA, 353 bp, Artificial
  Mutation in BnaC.FAD2.b introduced by TALE nuclease pair BnFAD2_T02
cctctcctccctcaccctctcccttacctcgcctgggccctctactgggcctgccaaggctgcgtcctaaccggcgtctgggtcatagcccacgagtgcggccaccacgccttcagcgactaccagttgctggacgacaccgtcggcctcatcttccactccttcctcctcgtcccttacttctcctggacatcgacgccaccattccaacaccggatccctcgagagggatgaagtgttcgtccccaagaagaaatccgacatcaagttgtacggaaagtacctcaacaacccgctaggacgcacggtgatgctaaccgtccatttcacgctcggctgccctttgtacttat

SEQ ID NO: 24290 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24291 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 24292 - DNA, 336 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcaccgcccacgaatgcggccaccacgccttcagcgaccaccagtggctggacgacaccgtcggcctcatcttccactccttcctcctcgtcatcgacgccaccattccaacactggctccctcgagagagacgaagtgtttgtccccaagaagaagtcagacatcaagtggtacggaaagtacctcaacagccggctaggacgcacggtgatgctaaccgtccaggtcaggctcgcctgcccttagtacttag

SEQ ID NO: 24293 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagttacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24294 - DNA, 362 bp, Artificial
  Mutation in BnaC.FAD2.b introduced by TALE nuclease pair BnFAD2_T02
cctctcctccctcaccctctatcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctgggacgcacggtgatgctaaccgtccagttcacgcgcggctggcctttgtacttag

SEQ ID NO: 24295 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaagtcagacatcaagtggtacggcaagtacctcaacaaccctttgggacgcacggtgatgctaaccgtccagttcacgctcggctggcctttgtacttag

SEQ ID NO: 24296 - DNA, 359 bp, Artificial
  Mutation in BnaC.FAD2.b introduced by TALE nuclease pair BnFAD2_T02
cctctcctccctcaccctctcccttacctcgcctggcccctctactggtcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 24297 - DNA, 388 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggcagttccctactctcgcgttcgaatacagccatcgacgccaccattccaacaccggatccctcgagagggatgaagtgttcgtccccaagaagaagtccgacatcaagtggtacggaaagtacctcaacaacccgctaggacgcacggtgatgctaaccgttcagttcacgctcgtctgcccttggtacttag

SEQ ID NO: 24298 - DNA, 384 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttttacttag

SEQ ID NO: 24299 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24300 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaaccggctaggacgcgcggtgatgctagccgtccatttcacgctcggcgggccgtggtacttag

SEQ ID NO: 24301 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24302 - DNA, 357 bp, Artificial
  Mutation in BnaC.FAD2.b introduced by TALE nuclease pair BnFAD2_T02
cctctcctccctcaccctctcccttacctcgcctgtaccatctactgggcctgccaaggctgcgtccaaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaaatccgacatcaagtggtacggaaagtacctcaacaacccgctaggacgcgtgcggatgctatccgccccgttcacgctcggctgccctttgtacttag

SEQ ID NO: 24303 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcgtctggcctttgtacttag

SEQ ID NO: 24304 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgatgttccagattacgctatcgatatcgccggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24305 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24306 - DNA, 324 bp, Artificial
  Mutation in BnaC.FAD2.b introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24307 - DNA, 358 bp, Artificial
  Mutation in BnaC.FAD2.b introduced by TALE nuclease pair BnFAD2_T02
cctctcctccctcaccctctctcctacttcgcctggcccctctcctgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccaggtgacgcgcggctggcctgagtacttag

SEQ ID NO: 24308 - DNA, 350 bp, Artificial
  Mutation in BnaC.FAD2.b introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggctggacgacgccgtggccctcgtcttccactccttcctcctcgtcccttacttctcctgatcgacgccaccattccaacaccggatccctcgagagggatgaagtgttcgtccccaagaagaaatcccacatcaagtggtacggaaaggaccgcaacaacccgcaagaacgcacggtgatgctaacccgccaggtgacgctcggctggcctttgtacttag

SEQ ID NO: 24309 - DNA, 353 bp, Artificial
  Mutation in BnaC.FAD2.b introduced by TALE nuclease pair BnFAD2_T02
cctctcctccatcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24310 - DNA, 323 bp, Artificial
  Mutation in BnaC.FAD2.b introduced by TALE nuclease pair BnFAD2_T02
ccttcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24311 - DNA, 388 bp, Artificial
  Mutation in BnaC.FAD2.b introduced by TALE nuclease pair BnFAD2_T02
cctctcctccctcaccctctcccttacctcgcctggcccctctcatgagcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcaataatggtggcaagcaggcgctggatccaagaagaaatccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 24312 - DNA, 359 bp, Artificial
  Mutation in BnaC.FAD2.b introduced by TALE nuclease pair BnFAD2_T02
cctctcctccctcaccctttctcctacttcgcctggcctctctaatgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 24313 - DNA, 312 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24314 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggaagtcatcgacgccaccattccatcaccggatccctcgagagggatgaagtgttcgtccccaagaagaaatccgacatcaagtggtacggaaagtacctcaacaacccgctaggacgcacggtgatgctaaccgtccagttcacgctcggcgggccttggtacttag

SEQ ID NO: 24315 - DNA, 443 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaagttggcattataaaaaagcattgctcatcaatttgttgcaacgaacaggtcactatcagtcaaaataaaatcattatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24316 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccggtggctggacgacaccgtcggcctcatcttccactccttcctcctcgtcccttacttctcctggaagttccatcgacgccaccattccaacaccggatccctcgagagggatgaagtgttcgtccccaagaagaaatccgacatcaagtggtacggaaagtacctcaacaacccgctaggacgcacggtgatgcgaaccgtccagttcacgctcggctggcctttgtacttag

SEQ ID NO: 24317 - DNA, 363 bp, Artificial
  Mutation in BnaC.FAD2.b introduced by TALE nuclease pair BnFAD2_T02
cctctcctccctcaccctctctcctacttcgcctggactctctactgggcctgccagggctgcgtcctaaccggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaaaaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 24318 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgaggctaaccgtccaggtcacgctcggctggcctttgtgctgag

SEQ ID NO: 24319 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggccgttgtacttag

SEQ ID NO: 24320 - DNA, 379 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttccactccttacttactcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24321 - DNA, 379 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttccactccttacttactcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgctaggacgcacgttgatgctaaccgtccagttcacgctcggctggcctttgtacttag

SEQ ID NO: 24322 - DNA, 359 bp, Artificial
  Mutation in BnaC.FAD2.b introduced by TALE nuclease pair BnFAD2_T02
cctctcctccctcaccctctcccttacctcgcctggcccctctactcggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaaccctctaggacgcacggtgatgctaaccgtccagttcacgctcggctggcctttgtacttag

SEQ ID NO: 24323 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtactgaaagtacctcaacaacccgctaggacgcacggtgattctaaccgtccaggtcacgctcggctggccgtagtacttag

SEQ ID NO: 24324 - DNA, 318 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24325 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagggatgaagtgttcgtccccaagaagaaatccgacatcaagtggtacggaaagtacctcaacaacccgctaggacgcacggtgatgctatccgtccagttcacgctcggctggccttggtacttag

SEQ ID NO: 24326 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcactctcggctggcctttgtacttag

SEQ ID NO: 24327 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctgtgtacttag

SEQ ID NO: 24328 - DNA, 357 bp, Artificial
  Mutation in BnaC.FAD2.b introduced by TALE nuclease pair BnFAD2_T02
cctctcctccctcaccctttcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatactatccgtccagttcacgctcggctggcctttgtacttag

SEQ ID NO: 24329 - DNA, 454 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtctccagcgcctgcttgccgccatcatatcactgtgtggcttcaggccgccatccactgcggagccgtacaaatgtacggccagcaacgtcggttcgagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24330 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24331 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaacagtccagttcacgctcggctggcctttgtacttag

SEQ ID NO: 24332 - DNA, 349 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcccatcgacgccaccattccaacactggctccctcgagagagacgaagtgtttgtccccaagaagaaatccgacatcaagtggtacggaaagtacctcaacaaccctctaggacgcacggtgatgctaaccgcccagttcacgctcggctgccctttgtacttag

SEQ ID NO: 24333 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24334 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 24335 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtgcctcaacaaccctttgggacgcaccgtgatgttaacggttcagttcactctcggctggcctgtgtacttag

SEQ ID NO: 24336 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcccaccattccaacaccggatccctcgatagggacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 24337 - DNA, 356 bp, Artificial
  Mutation in BnaC.FAD2.b introduced by TALE nuclease pair BnFAD2_T02
cctctcctccctcaccctctcccttacctcgcctgacccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggccttagtacttag

SEQ ID NO: 24338 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagtcatcgacgccaccattccaacaccggatccctcgagagagatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24339 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccattacttctccggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24340 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24341 - DNA, 412 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcacagcaccggcaacagccgctgggccaggaaccgtaaaaaggccgcgttgcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24342 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24343 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagtgttcgtccccaagaagaaatccgacatcaagtggtacggaaagtacctcaacaacccgctaggacgcacggtgatgccaaccgtccagttcacgctcggctggcctttgtacttag

SEQ ID NO: 24344 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctctgctggcctttgtacttag

SEQ ID NO: 24345 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttagtccccaagaagaaatccgacatcaagtggtacggaaagtacctcaacaacccgctaggacgcacggtgatgctaaccgtccagttcacgctcggctggcctttgtacttag

SEQ ID NO: 24346 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgcgcggctggccttagtacttag

SEQ ID NO: 24347 - DNA, 383 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgagcctctgggtcatcgcccacgaatgcggccaccacgccttcagcgaccaccagtggctggacgacgccgtgggcctcgtcctgagtaggacaaatccgccgggagcggatttgaacgttgttaagcaacggcccggagggtggcgggcgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24348 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaactggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatcctacatcaagtggtacggaaagtacctcaacaacccgctaggacgcacggtgatgctaaccgtccagttcacgctcggctggcctttgtacttag

SEQ ID NO: 24349 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24350 - DNA, 347 bp, Artificial
  Mutation in BnaC.FAD2.b introduced by TALE nuclease pair BnFAD2_T02
cctctcctccctcaccctctcccttacctcgcctgtaccctccactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggcaagtacctcaacaacccttagggacgcatcgggatcttaccggttcagctcactctcggctggcctttgtacttag

SEQ ID NO: 24351 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 24352 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaacggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcatggggatgctaaccgtccagttcacgctcggctggccgtggtacttag

SEQ ID NO: 24353 - DNA, 359 bp, Artificial
  Mutation in BnaC.FAD2.b introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24354 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccacaagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24355 - DNA, 345 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24356 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggccttagtacttag

SEQ ID NO: 24357 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccacaagaagaaatccgacatcaagtggtacggaaagtacctcaacaacccgctaggacgcacggtgatgctaaccgtccagttcacgctcggctggcctttgtacttag

SEQ ID NO: 24358 - DNA, 438 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatccgactgagcctttcgttttatctgttgtttgtcggtgaacgctctcctgagtaggctccgcccccctgacgagcagcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24359 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggccgttgtacttag

SEQ ID NO: 24360 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24361 - DNA, 356 bp, Artificial
  Mutation in BnaC.FAD2.b introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24362 - DNA, 358 bp, Artificial
  Mutation in BnaC.FAD2.b introduced by TALE nuclease pair BnFAD2_T02
cctctcctccctcaccctctctcctacttctcctggcctctctactcggcctcccaagtctgcgtcctaacgggcctctgggtcatcgcccacgaatgcgtccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcaaggtgatgctaaccgtccagttcacgctcggctggcctttgtacttag

SEQ ID NO: 24363 - DNA, 357 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgattctaaccgtccagttcacgctcggctggcctttgtacttag

SEQ ID NO: 24364 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggcaagtacatcaacaaccctttgggacgcaccgtgatgttaacggttcagttcactctcggctggcctttgtacttag

SEQ ID NO: 24365 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgctaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 24366 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgattctaaccgtccagttcacgctcggctggcctttgtacttag

SEQ ID NO: 24367 - DNA, 356 bp, Artificial
  Mutation in BnaC.FAD2.b introduced by TALE nuclease pair BnFAD2_T02
cctctcctccctcaccatctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcacgctcggctggccttgttacttag

SEQ ID NO: 24368 - DNA, 345 bp, Artificial
  Mutation in BnaC.FAD2.b introduced by TALE nuclease pair BnFAD2_T02
cctctcctccctcaccctctctcctacttcgcctggactctctactgagcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctacgccaccattccaacaccggatccctcgagatggatgaagtgttcgtccccaagaagaaatccgacatcaagtggtacggaaagtacctcaacaacccgctagggcgcacggtgatgcgaaccgtccagttcacgctcggctggcctttgtacttag

SEQ ID NO: 24369 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24370 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtagctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24371 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24372 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24373 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24374 - DNA, 379 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttccactccttacttactcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgcgaggacgcacggtgatgctaaccgtccatttcacgctcggctggcctttgtacttag

SEQ ID NO: 24375 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaacagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24376 - DNA, 389 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24377 - DNA, 356 bp, Artificial
  Mutation in BnaC.FAD2.b introduced by TALE nuclease pair BnFAD2_T02
cctctcctccctcaccctctcccttacctcgcctggcccctccactcggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaatggaccgcaacaacccgctaggacgcacggtgatgctaaacgcccatgtcacgcgcggctggccgtagcacttag

SEQ ID NO: 24378 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24379 - DNA, 358 bp, Artificial
  Mutation in BnaC.FAD2.b introduced by TALE nuclease pair BnFAD2_T02
cctctcctccctcaccctctctcctacttcgcctggactctctactgggcctgccaggactgcgtcctaaccggcgtctgggtcatcgcccacgagtgcggccaccacgccttcagcgaccaccagtggctggacgacaccgtcggcctcatcttccactccttcctcctcgtcccttacttctcctggaaaagccatcgacgccaccattccaacaccggatccctcgagagggatgaagtgttcgtccccaataagaaatccgacatcaagtggtacggaaagtacctcaacaacccgctaggacgcacggggatgctaaccgtccagttcacgctcggctggcctttgtacttag

SEQ ID NO: 24380 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacacagccatcgacgccaccattccaacaccggatccctcgagagggatgaagtgttcgtccccaagaagaaatccgacatcaagtggtacggaaagtacctcaacaacccgctaggacgcacggtgatgctaaccgttcagttcacgctcggctggcctttgtacttag

SEQ ID NO: 24381 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24382 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgtttgtccccaagaagaagtcagacatcaagtggtacggcaagcacctcaacaaccctttgggacgcaccgtgatgttaacggttcagttcactctcggctggcctttgtacttag

SEQ ID NO: 24383 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 24384 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24385 - DNA, 358 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaagtcagacatcaagtggtacggcaagtacctcaacagccctttgggacgcaccgtgatgttaacggttcagttcactctcggctggccgttgtacttag

SEQ ID NO: 24386 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggatgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 24387 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctatccgtccagttcacgcgcggctggcctttgtacttag

SEQ ID NO: 24388 - DNA, 379 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttccactccttacttactcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgctaggacgcacggtgatgctaaccgtgcatgtcacgcgcggctggccttagtacttag

SEQ ID NO: 24389 - DNA, 453 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaagcgcaacggctgttgccggtgctgtgccaggcccacggcttgaccccccagcaggtgggggccatcgccagcaatggcggtggcaagcaggcgctggtcatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 24390 - DNA, 357 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccattgtacttag

SEQ ID NO: 24391 - DNA, 322 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggtttgtacttag

SEQ ID NO: 24392 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgtcctttgtacttag

SEQ ID NO: 24393 - DNA, 357 bp, Artificial
  Mutation in BnaC.FAD2.b introduced by TALE nuclease pair BnFAD2_T02
cctctcctccctcaccctctctcctacttcgcctggccactctcatgagcctgccaagggtgcgtcctaacaggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagggatgaagtgttcgtccccaagaagaaatccgacatcaagtggtacggaaagtacctcaacaacccgctaggacgcacggtgattcaaaccgtccatttcacgcgcggctggccttagtacttag

SEQ ID NO: 24394 - DNA, 383 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagactgagcctttcgttttatttgatgcgtcatcgacgccaccattccaacactggctccctcgagagagacgaagtgttcgtccccaagaagaaatccgacatcaagtggtacggaaagtacctcaacaacccgctaggacgcacggtgatgctaaccgtacagttcacgctcggctggcctttgtacttag

SEQ ID NO: 24395 - DNA, 432 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagcggctgttgccggtgctgtgccaggcccacggcttgaccccccgggcccgggatccgatccaatgctatgaccatgattacgaattcccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24396 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcacccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24397 - DNA, 349 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcgacgccaccattccaacaccggatccctcgagggggatgaagtgttcgtccccaagaagaaatccgacatcgagtggtacggaaagtacctcaacaacccgctagggcgcacggtgatgctaaccggccaggtcacgctctgctggccgttggacttag

SEQ ID NO: 24398 - DNA, 331 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcgtcttccactccttcctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24399 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24400 - DNA, 352 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24401 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcggcgccaccattccaacaccggatccccgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 24402 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggccgtggtacttag

SEQ ID NO: 24403 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24404 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggttgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24405 - DNA, 356 bp, Artificial
  Mutation in BnaC.FAD2.b introduced by TALE nuclease pair BnFAD2_T02
cctctcctccctcaccctctctcctacttcgcctgacccctctactgagcctgccaaggctgcgccctaacgagcctctgggtcatcgcccacgaatgcggccaccacgccttcagcgaccaccagtggctggacgacgccgtgggcctcgtcttccactccttcctcctcgtcccttacttctcctggatgccatcgacgccaccattccaacaccggatccctcgagagggatgaagtgttcgtccccaagaagaaatccgacatcaagtggtacgaaaagtacctcagcaacccgctaagacgcacggtggtcctaaccgtccagttcacgctcggctggcctttgtacttag

SEQ ID NO: 24406 - DNA, 444 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcaggcctctgcagtcgacgggcccgggatccgatccaatgaccccccagcaggtggtggccatcgccagcaataagggtggcacagccatcgacgccaccattccaacaccggatccctcgagagggatgaagtgttcggccccaagaagaaatccgacatcaagtggtacggaaagtacctcaacaacccgctaggacgcacggtgatgctaaccgtccagttcacgctcggctggcctttgtacttag

SEQ ID NO: 24407 - DNA, 385 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24408 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgttcggctggcctttgtacttag

SEQ ID NO: 24409 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggccgttgtacttag

SEQ ID NO: 24410 - DNA, 324 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaagtcagacatcaagtggtacggcaagtacctcaacagccctttgggacgcaccgtgatgttaacggttcagtgcactctcggctggcctttgtacttag

SEQ ID NO: 24411 - DNA, 388 bp, Artificial
  Mutation in BnaC.FAD2.b introduced by TALE nuclease pair BnFAD2_T02
cctctcctccctcaccctctcccttacctcgtctggcctctctactgggcctgccaagggtgcgtcctaacaggcgtctgggtcatagcccacgagtgcggccaccacgccttcagcgactaccagtggcttgacgacaccgtcggtctcatcttccactccttcctcctcgtcccttacttctcctggaagccttctgcttagtttgatgcctggcagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24412 - DNA, 357 bp, Artificial
  Mutation in BnaC.FAD2.b introduced by TALE nuclease pair BnFAD2_T02
cctctcctccctcaccctctcccttacctcgcctggcccctctactcagcctgccaaggctgcgtcctaacgggcctctgggtcatcgcccacgaatgcggccaccacgccttcagcgaccaccagtggctcgacgacgccgtgggcctcgtcttccactccttcctcctcgtcccttacttctcctggaaagccatcgacgccaccattccaacaccggatccctcgagagggatgaagtgttcgtccccaagaagaaacccgacatcaagtggtacggaaagtacctcaacaacccgctaggacgcacggtgatgctacccgcccagttcccgctcggctggcctttgtacttag

SEQ ID NO: 24413 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcagcaacccgctaggacgcacggtgatgctaaccgtccagttcacgctcggctggcctttgtacttag

SEQ ID NO: 24414 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24415 - DNA, 362 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctagtcttccactccttcctcctcgtcccttacttctcctggaagtaaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtactgag

SEQ ID NO: 24416 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgcctttgtacttag

SEQ ID NO: 24417 - DNA, 312 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacaccggatccctcgagagggatgaagtgttcgtccccaagaagaaatccgacatcaagtggtacggaaagtacctcaacaacccgctatgacgcacggtgatgctaaccgtccagttcacgctcggctggcctttgtacttag

SEQ ID NO: 24418 - DNA, 394 bp, Artificial
  Mutation in BnaC.FAD2.b introduced by TALE nuclease pair BnFAD2_T02
cctctcctccctcaccctctatcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24419 - DNA, 359 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccaccccttcagcgaccaccagtggctggacgacgccgtgggcctcgtcttccactccttcctcctcgtcccttacttctcctggaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcccttgtacttag

SEQ ID NO: 24420 - DNA, 422 bp, Artificial
  Mutation in BnaC.FAD2.b introduced by TALE nuclease pair BnFAD2_T02
cctctcctccctcaccctctcccttacctcgcctgacccctctactgggcctgccaaggctgcgtcctaacgggcctctgggtcatcgcccacgaatgcggccaccacgccttcagcgcccaccagtggctggacgacgccgtgggcctcgtcttccactccttcctcctcgacccttacttctcctggaaggcgatggagacggtccagcggctgttgccggtgctgtgccaggcccacggcttgaccccccagcagccatcgacgccaccattccaacaccggacccctcgagagggatgaagtgtgcgtccccaagaagaaatccgacatcaagtggtacggaaagtacctcaacaacccgcgaggacgcccggtgatgctaaccgtccagttcacgctcggctggccttagtacttag

SEQ ID NO: 24421 - DNA, 396 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcaatttgttgcaacgaacaggtcactatcagtcaaaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24422 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggagccctcgagagggatgaagtgttcgtccccaagaagaaatccgacatcaagtggtacggaaagtacctcaacaacccgctaggacgcacggtgatgctaaccgtccagttcacgctcggcgggcctttgtacgtag

SEQ ID NO: 24423 - DNA, 357 bp, Artificial
  Mutation in BnaC.FAD2.b introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24424 - DNA, 324 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24425 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24426 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccactaggacgcacggtgatgctaaccgtccagttcacgctcggctggcctttgtacttag

SEQ ID NO: 24427 - DNA, 385 bp, Artificial
  Mutation in BnaC.FAD2.b introduced by TALE nuclease pair BnFAD2_T02
catctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24428 - DNA, 337 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaagtcagacatcaagtggtacggaaagtacctcaacaacccgctaggacgcacggtgatgctaaccttccagttcacgctcggctggcctttgtacttag

SEQ ID NO: 24429 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 24430 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaattgttcgtccccaagaagaaatccgacatcaagtggtacggaaagtacctcaacaacccgctaggacgcacggtgatgctaaccgtccagttcacgctcggctggcctttgtacttag

SEQ ID NO: 24431 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24432 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaacatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24433 - DNA, 352 bp, Artificial
  Mutation in BnaC.FAD2.b introduced by TALE nuclease pair BnFAD2_T02
cctctctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24434 - DNA, 369 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24435 - DNA, 356 bp, Artificial
  Mutation in BnaC.FAD2.b introduced by TALE nuclease pair BnFAD2_T02
cctctcctccctcaccctctctcctacttcgcctggcctgtttaatgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcggtagggatgaagtgttcgtccccaagaagaaatccgacatcaactggtacggaaagtgcctcaacaacccgctaggacgcacagtgacgctaaccgtccatgtcacgcacgcctgccctgagtacttag

SEQ ID NO: 24436 - DNA, 326 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaccccgctaggacgcacggggatgctaaccgtccaggtcacgctcggctggcctttgtacttag

SEQ ID NO: 24437 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaccactggctccctcgagagagacgaagtgtttgtccccaagaagaaatccgacatcaagtggtacggcaagtacctcaacaaccctgtgggacgcaccgtgatgttaacggttcagttcacgctcggctggcctttgtacttag

SEQ ID NO: 24438 - DNA, 388 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtggcagttccctactctcgcgttcgaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24439 - DNA, 340 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 24440 - DNA, 391 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24441 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgatgttccagattacgctatcgatatcgccggccatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 24442 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagggatgaagtgttcgtccccaagaagaaatccgacatcaagtggtacggcaagtacctcaacaaccctttgggacgcaccgtgatgttaacggtccagttcacgctcggctggcctttgtacttag

SEQ ID NO: 24443 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtccttag

SEQ ID NO: 24444 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggaagacaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24445 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24446 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagttgctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24447 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaggtgttcgtccccaagaagaaatccgacatcaagtggtacggaaagtacctcaacaacccgctaggacgcacggtgatgctaaccgtccagttcacgctcggctggcctttgtacttag

SEQ ID NO: 24448 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtaccccaacaacccgctaggacgcacggtgatgctaaccgtccagttcacgctcggctggcctttgtacttag

SEQ ID NO: 24449 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24450 - DNA, 385 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcgtcttccactccttcctcctcgtcccaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24451 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24452 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttcactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24453 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgaggctaaccgtccagttcacgctcggctggcctttgtacttag

SEQ ID NO: 24454 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24455 - DNA, 357 bp, Artificial
  Mutation in BnaC.FAD2.b introduced by TALE nuclease pair BnFAD2_T02
cctctcctccctcaccctctctcctacttcgcttggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24456 - DNA, 362 bp, Artificial
  Mutation in BnaC.FAD2.b introduced by TALE nuclease pair BnFAD2_T02
cctctcctccctcaccctctcccttacctcgcctggcccctctcctgagcctgccaaggctgcgtcctaacgggcctctgggtcatcgcccacgaatgcggccaccacgccttcaccgaccaccagtggctggacgacgccgtgggcctcgtcttccactccttcctcctcgtcccttacttctcctggaagtcacagccatcgccgccaccattcccacaccggatccctcgagagggatgaagtgttcgtccccaagaagaagtcagacctcaagtggtacggcaggtacctcagcatccctttgggacgcaccgtgatgttaacgttgcaggtcactctcggctgccctttgtacttag

SEQ ID NO: 24457 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcttgcctttgtacttag

SEQ ID NO: 24458 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgtggccaccacgccttcagcgaccaccagtggctggacgacgccgtgggcctcttcttccactccttcctcctcgtcccttacttctcctggaagccatcgacgccaccattccaacaccggatccctcgagagagatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24459 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcgtcttccactccttcctcctcgtcccttacttctcatcgacgccaccaatccaacaccggatccctcgagagggatgaagtgttagtccccaagaagaaatccgacatcaagtggtacggaaagtacctcaacaacccgctaggacgcacggtgatgctaaccgtccagttcacgctcggctggcctttgtacttag

SEQ ID NO: 24460 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24461 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgcagtgggcctcgtcttccactccttcctcctcgtcccttacttctcctggaagtacacaaccatcgacgccaccattccaacaccggatccctcgagagggatgaagtgttcgtccccaagaagaaatccgacatcaagtggtacggaaagtacctcaacaacccactaggacgcacggtgatgctgaccctccagttcacgctcggctggcatttgtacttag

SEQ ID NO: 24462 - DNA, 336 bp, Artificial
  Mutation in BnaC.FAD2.b introduced by TALE nuclease pair BnFAD2_T02
cctctcctccctcaccctctcccttacctcggctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24463 - DNA, 357 bp, Artificial
  Mutation in BnaC.FAD2.b introduced by TALE nuclease pair BnFAD2_T02
cctctcctccctcaccctctcccttacctcgcctggccactctactgggcctgcaaaggctgcgtccaaacgggcatatgggtcatcgcccacgaatgcggccaccacgccttaagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtccacgctcggctggcctttgtacttag

SEQ ID NO: 24464 - DNA, 357 bp, Artificial
  Mutation in BnaC.FAD2.b introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24465 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtcacagccatcgacgccaccattccaacaccggatccctcgagacggatgaagtgttcgtccccaagaagaaatccgacatcaactggtccggaaagtacctcaacaacccgctaggacgcacggtgatgctaaccgtccagttcacgctcggctggcctttgtacttag

SEQ ID NO: 24466 - DNA, 357 bp, Artificial
  Mutation in BnaC.FAD2.b introduced by TALE nuclease pair BnFAD2_T02
cctctcctccctcaccctctctcctacttcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctagaacgcacggtgatgctaaccgtcgagttcacgctcggctggcctgtgtacttag

SEQ ID NO: 24467 - DNA, 355 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24468 - DNA, 274 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24469 - DNA, 389 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggccccatcttccactccttcctcctcgtcccttacttctcctggaagtctggcgccgtcgggcttcctggagccgcccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24470 - DNA, 357 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24471 - DNA, 438 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatccgactgagcctttcgttttatctgttgtttgtcggtgaacgctctcctgagtaggctccgcccccctgacgagcatcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24472 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24473 - DNA, 350 bp, Artificial
  Mutation in BnaC.FAD2.b introduced by TALE nuclease pair BnFAD2_T02
cctctcctccctcaccctatcccttacctcgcctgccccctctactgggcctgccaaggatgcgtcctaacgggcctctgggtcatcgcccacgaatgtggccaccacgccttcagcgaccaccagtggctggacgacgccgtgggcctagtcttccactccttcctcctcgtcccttacttctcctgatcgacgccaccattccaacaccggatccctcgagagggatgaagtgttcgtccccaagaagaaatccgacatcaagtggtacggaaagtagctgagcatccctctatgacgcacggtgaggctaagcctccagttcaggctcggcgggcctttggacttag

SEQ ID NO: 24474 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggcctcatcttccactccttcctcctcgtcccttacttctcctggaagtcaccgtcgccaccattccaaccctgcctccctctagatagacgaagtgtttgtcccccagacgaaagcccacatcaactggtccggaaagtacctcaacaacccgctaggacgcacggtgatgctaaccgtccagttcacgctcggctggcctttgtacttag

SEQ ID NO: 24475 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaaccgttggggacgcaccgtgatgttaacggttcagttcactctcggctggcctttgtacttag

SEQ ID NO: 24476 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24477 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggagccatcgacgccaccattccaacaccggatccctcgagagggatgaagtgttcgtccccaagatgaaatccgacatcaactggtccggaaagtacctcaacaacccgctaggacgcacggtgatgctaaccgtccagttcacgctcggctggcctttgtacttag

SEQ ID NO: 24478 - DNA, 350 bp, Artificial
  Mutation in BnaC.FAD2.b introduced by TALE nuclease pair BnFAD2_T02
cctctcctccctcaccctctcccttacctcgcctggcccctctacagggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 24479 - DNA, 356 bp, Artificial
  Mutation in BnaC.FAD2.b introduced by TALE nuclease pair BnFAD2_T02
cctctcctccctcaccctctctcctacttcgcctcgcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24480 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24481 - DNA, 384 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgggcgctcggtcgttcggctgcggcgagcggagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24482 - DNA, 357 bp, Artificial
  Mutation in BnaC.FAD2.b introduced by TALE nuclease pair BnFAD2_T02
cctctcctccctcaccctctcccttacctcgcctggcccctatactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24483 - DNA, 358 bp, Artificial
  Mutation in BnaC.FAD2.b introduced by TALE nuclease pair BnFAD2_T02
cctctcctccctcaccctctctcctacttcgcctggctcctctactctgcctgccaaggctgcgccctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaggtacctcaacaacccactaggacgcacgatgaagctaaccgtccagttcacgctcggctggcctttgtacttag

SEQ ID NO: 24484 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaacccgctaggacgcacggtgatgctaaccttccagttcacgctcggctggcctttgtacttag

SEQ ID NO: 24485 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24486 - DNA, 351 bp, Artificial
  Mutation in BnaC.FAD2.b introduced by TALE nuclease pair BnFAD2_T02
cctctcccaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24487 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24488 - DNA, 274 bp, Artificial
  Mutation in BnaC.FAD2.b introduced by TALE nuclease pair BnFAD2_T02
cctctcctccctcaccctctcccttacctcgcctggcccctctcctgggcctaccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24489 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcttctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24490 - DNA, 366 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccggtggcttgacgacaccgtcggtctcatcttccactccttcctcctcgtcccttacttctcctggaagtacaatacagtcatcgacaccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24491 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcccaccattccaacaccggatccctcgagagggatgaagtgttcgtccccaagaagaaatccgacatcaagtggtacggaaagtacctcaacaacccgctaggacgcacggtgaggctaaccgtccagttcacgctcggcggcccgttgtacttag

SEQ ID NO: 24492 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgactaccagtggcttgacgacaccgtcggtctcatcttccactccttcctcctcgtcccttacttctcctggaagtagtcatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24493 - DNA, 359 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24494 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtatacagtcatcgacgccaccattccaacaccggatccctcgagagggatgaagtgttcgtccccaagaagaaatccgacatcaagtggtacggaaagtacctcaacaacccgctaggacgcacggtgaggctaacggttcagttcactctcggctggcctttgtacttag

SEQ ID NO: 24495 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctaggctggcctttgtacttag

SEQ ID NO: 24496 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattcgacgccaccattccaacaccggatccctcgagagggatgaagtgttcgtccccaagaagaaatccgacatcaagtggtacggaaagtacctcaacaacccgctaggacgcacggtgatgctaagcgtccagttcacgctcggctggcctgtgtacttag

SEQ ID NO: 24497 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaaccctttgggacgcaccgtgatgttaacgtttcagttcactctcggctggcctttgtacttag

SEQ ID NO: 24498 - DNA, 354 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 24499 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctatgacgcacggtgatgctaaccgtccagttcacgctcggctggcctttgtacttag

SEQ ID NO: 24500 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggcaagtacctcaacaacccttttggacgcaccgtgatgttaacggttcagttcactctcggctggcctttgtacttag

SEQ ID NO: 24501 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagagatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24502 - DNA, 357 bp, Artificial
  Mutation in BnaC.FAD2.b introduced by TALE nuclease pair BnFAD2_T02
cctctcctccctcaccctctcccttacctcgcctggcccctttactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaccaacccgctagtacgcacggtgatgctaaccctcccgctcacgctcggctggcctttgtacttag

SEQ ID NO: 24503 - DNA, 383 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtttgaccccggagcaggtggtggccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24504 - DNA, 356 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24505 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcaagctcggctggcctttgtacttag

SEQ ID NO: 24506 - DNA, 273 bp, Artificial
  Mutation in BnaC.FAD2.b introduced by TALE nuclease pair BnFAD2_T02
cctctcctccctcaccctctcacttacctcgcctggcccctctactgggcctgtcaaggctgcgtcctaacgggcctctgggtcatcgccaacaaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24507 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacagcccgctaggacgcacggtgatgctaaccgtccagttcacgctcggctggccgtggtacttag

SEQ ID NO: 24508 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24509 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcggcccttacttctcctggaagccatcgacgccaccattccaacaccggatccctcgagagggatgaagtgttcgtccccaagaagaagtcagacatcaagtggtacggcaagtgcctcaacaacccgctaggacgcacggtgatgctaaccgtccagttcacgctcggctggcctttgtacttag

SEQ ID NO: 24510 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacagcccgctaggacgcacggtgaggctaagcgtgcagttcactcttggctgcccgttgtacttag

SEQ ID NO: 24511 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctgtgtacttag

SEQ ID NO: 24512 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24513 - DNA, 473 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccacggcttgaccccggagcaggtggtggccatcgccagccacgatggcggcaagcaggcgctggagacggtccagcggctgttgccggtgctgtgccaggcccacggcttgaccccccagcaggtcatcgacgccaccattccaacactggctccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 24514 - DNA, 357 bp, Artificial
  Mutation in BnaC.FAD2.b introduced by TALE nuclease pair BnFAD2_T02
cctctcctccctcaccctctcccttacctcgtctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttatttctcctggaaagtcatcgacgccaccattccaacactggctccctcgagagagccgaagtgtttgtccccaagaagaagtcagacatcaagtggtacggcaagttcctcaacaacccgctaagacgcacggtgatgctaaccgtccagttcacgctcggctggcctttgtactcag

SEQ ID NO: 24515 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 24516 - DNA, 310 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggtctcatcttccaccattccaacactggctccctcgagagggatgaagtgttcgtccccaagaagaaatccgacatcaagtggtacggaaagtacctcaacaacccgctaggacgcacggtgaggctaaccgtccagttcacgcccggctgccctttgtacttag

SEQ ID NO: 24517 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccactccaacaccggatccctcgagagggatgaagtgttcgtccccaagaagaaatccgacatcaagtggtacggaaagtacctcaacaacccgctaggacgcacggtgatgctaaccttccagttcacgctcggctggccgttgtacttag

SEQ ID NO: 24518 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 24519 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagtgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24520 - DNA, 357 bp, Artificial
  Mutation in BnaC.FAD2.b introduced by TALE nuclease pair BnFAD2_T02
cctctcctccctcaccctctcccttacctcgtctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24521 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 24522 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24523 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24524 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 24525 - DNA, 409 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggagcaacagccgctggaccgtctccagcgcctgcttgccgccatcgtggctggcgagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24526 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcacgctcggctggcctttgtacttag

SEQ ID NO: 24527 - DNA, 354 bp, Artificial
  Mutation in BnaC.FAD2.b introduced by TALE nuclease pair BnFAD2_T02
ccttcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24528 - DNA, 356 bp, Artificial
  Mutation in BnaC.FAD2.b introduced by TALE nuclease pair BnFAD2_T02
cctctcctccctcaccctctcccttacctcgcctggcccctctactgggccttccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24529 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtcaagttcacgctcggctggcctttgtacttag

SEQ ID NO: 24530 - DNA, 412 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgcacagcaccggcaacagccgctgggccaggaaccgtaaaaaggccgcgttgcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24531 - DNA, 333 bp, Artificial
  Mutation in BnaC.FAD2.b introduced by TALE nuclease pair BnFAD2_T02
cctctcctccctcaccctgtcccttacctcgcctggctcctctactgggcctgccaaggctgcgtcctaacggccctctgggtcatcgcccacgaatgcggccaccacgccttcagcgaccaccagtggctggacgacgccgtgggcctcgtcttccactccttcctcctcatcgacgccaccattccaacaccggatccctcgagagggatgaagtgttcgtccccaagaagaaatccgacatcaagtggtacggaaagtacctcaacaacccggtaggacgcacggtgaggctaaccgtccagttcacgctcggcgggccgttgtacttag

SEQ ID NO: 24532 - DNA, 336 bp, Artificial
  Mutation in BnaC.FAD2.b introduced by TALE nuclease pair BnFAD2_T02
cctctcctccctcaccctctctcctacttcgcctggcctctctacttggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24533 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtgactggacgacgccgtgggcctcgtcttccactccttcctcctcgtcccttacttctcctggaagtaacagtcatcgacgccaccattccaacaccggatccctcgagagggatgaagtgttcgtccccaagaagaagtcagacatcaagtggtacggcaagtacctcaacaaccctttgggacgcaccgtgatgttaacgtttcagttcactctcggctggcctttgtacttag

SEQ ID NO: 24534 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacggtcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24535 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccattacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24536 - DNA, 353 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24537 - DNA, 341 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcctctgggtcatcgcccacgaatgcggccaccacgccttcagcgaccaccagtggctggacgacgccgtgggcctcgtcttccactccttcctcctcgtcccttacttctcctggaagtaccggataccggatccctcgagagggatgaagtgttcgtccccaagaagaaatccgacatcaagtggtacggaagtacctcaacaacccgctaggacgcacggtgatgctaaccgtccagttcacgctcggctggcctttgtacttag

SEQ ID NO: 24538 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24539 - DNA, 358 bp, Artificial
  Mutation in BnaC.FAD2.b introduced by TALE nuclease pair BnFAD2_T02
cctctcctccctcaccctctctcctacttcgcctggcatctctcctaggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagccatcgacgccaccattccaacaccggatccctcgagagggatgaagtgttcgtccccaagaagaaatccgacatcaagtggtacggaaagtgcctctacaacccgctagaacgcacggtgatgctaaccgtccaggtcacgctccgctggcctgtgtacttag

SEQ ID NO: 24540 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24541 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 24542 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24543 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgcaaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24544 - DNA, 345 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagttgctggacgacaccgtcggcctcatcttccactccttcctcctcgtcccttacttctcctacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24545 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctgtgtacttag

SEQ ID NO: 24546 - DNA, 362 bp, Artificial
  Mutation in BnaC.FAD2.b introduced by TALE nuclease pair BnFAD2_T02
cctctcctccctcaccctgtctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaatccgacatcaagtggcacggaaagtacctcaacaacccgctaggacgcacggtgatgctaaccgtccagctcacgctcggctggcctttgtacttag

SEQ ID NO: 24547 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacacctgatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24548 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24549 - DNA, 336 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24550 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggatgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24551 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgacttcagcgaccaccagtggctggacgacgccgtgggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaacgtccagttcacgctcggctggcctttgtacttag

SEQ ID NO: 24552 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccacgccttcctcctcgtcccttacttctccaggagagccatcgacgccgccattccaactccgcgtccctctaggggaatgaggggttcgtccccaagaagaaagccgacgtcaagtggtacggaaagtacctcaacaacccataagggcgcacggtgatgctaaccggccagtgcacgccctgctggcctttgtacttag

SEQ ID NO: 24553 - DNA, 273 bp, Artificial
  Mutation in BnaC.FAD2.b introduced by TALE nuclease pair BnFAD2_T02
cctctcctccctcaccctctcccttacctcgcctggcccctctacttggcctgccaaggctgcgtcctaacgggcctctgggtcatcgcccacgaatgcggccatcacgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24554 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaagctgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24555 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24556 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatccctcgagacggatgaagtgttcgtccccaagaagaaatccgacatcaagtggtacggaaagtacctcaacaacccgctaggacgcacggtgatgctatccttccagttcacgcccggctggccttagtacttag

SEQ ID NO: 24557 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtcgagttcacgctcggctggcatttgtacttag

SEQ ID NO: 24558 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24559 - DNA, 359 bp, Artificial
  Mutation in BnaC.FAD2.b introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaagccgacatcaagtggtacggaaagtacctcaacaacccgctaggacgcacggtgatgctaaccttccatttcacgctcggctggcctttgtacttag

SEQ ID NO: 24560 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24561 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtaggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24562 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 24563 - DNA, 454 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtacatactggaaagcgggcagtgagcgcaacgcaattaatacgcgtaccgctagccaggaagagtttgtagaaacgcaaaaaggccatccgtcagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24564 - DNA, 324 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctagtacgcacggtgatgctaaccgtccagttctcgctcggctggccttagtacttag

SEQ ID NO: 24565 - DNA, 347 bp, Artificial
  Mutation in BnaC.FAD2.b introduced by TALE nuclease pair BnFAD2_T02
cctctcctccctcaccctctctcctacttcgcctggcccctctactgggcccgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24566 - DNA, 348 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagtgttcgtccccaagaagaaatccgacatcaagtggtacggaaagtacctcaacaacccgctaggacgcacggtgatgctaaccttccagtgcacgctcggctggcctgagtacttag

SEQ ID NO: 24567 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtaactcaacaacccgctaggacgcacggtgatgctaaccgtccagttcacgctcggctggcctgtgtacttag

SEQ ID NO: 24568 - DNA, 332 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24569 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacagcaagtggtacggaaagtacctcaacaacccgctaggacgcacggtgatgctaaccgtccagttcacgctaggctggcctttgtacttag

SEQ ID NO: 24570 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24571 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggccatcgacgccaccattccaacaccggatccctcgagagggatgaagtgttcgtccccaagaagaaatccgacatcaagtggtacggcaagtacctcaacaaccctgggggacggaccgggaggttaacggttcagtggacgctcggctggccggggtacttag

SEQ ID NO: 24572 - DNA, 389 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaggatctcaagaagatcctttgatcttttctacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24573 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24574 - DNA, 345 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggcttgacgacaccgtcggtctcatcttccactccttcctcctcgtcccttacttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24575 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 24576 - DNA, 273 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24577 - DNA, 349 bp, Artificial
  Mutation in BnaC.FAD2.b introduced by TALE nuclease pair BnFAD2_T02
cctctcctcctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttactcctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24578 - DNA, 346 bp, Artificial
  Mutation in BnaC.FAD2.b introduced by TALE nuclease pair BnFAD2_T02
cctctcctccccaccctctctcctacttcgcctggcctctctaccgggcctgccaaggctgcgtcctaacgggcctctggggcatcgcccacgaacgcggccaccacgccttcaacgaccaacaagggctggacgaccccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24579 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24580 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24581 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagagacgaagtgtttgtccccaagaagaagtcagacatcaagtggtacggcgagtacctcaacaaccctgtgggacgcaccgtgatgttaacggttcagttcactctcggctggcctttgtacttag

SEQ ID NO: 24582 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24583 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtggctccatcgacgccaccattccaacaccggatccctcgagagggatgaagtgttcgtccccaagaagaaagccgacatcaagtggtacggaaagtacctcaacaacccgctaggacgcacggtgatgctaaccgtccagtgcacgctcggctggccgttgtacttag

SEQ ID NO: 24584 - DNA, 407 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttctccagcggctgttgccgccatcgtggctggcgatggccaccacctgagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24585 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24586 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaatgctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtccggcaagtccctcaacatccatatgggacgccccctcctcccacccgttcagtccaccctcggctggcctttgtacttag

SEQ ID NO: 24587 - DNA, 348 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtattag

SEQ ID NO: 24588 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatcccttgagagggatgaagtgtttgtccccaagaagaagtcagacatcaagtggtacggcaagtacctcaacaaccctttgggacgcaccgtgatgttaacggttcagttcactctcggctggccttggtacttag

SEQ ID NO: 24589 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24590 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24591 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgccctttgtacttag

SEQ ID NO: 24592 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccggtggctggacgacgccgtgggcctcgtcttccactccttcctcctcgtcccttacttctcctggagccatcgacgccaccattccaacaccggatccctcgagagggatgaagtgttcgtccccaagtagaagtcagacatcaagtggtacggcaagtacctcaacaaccctttgggacgcaccgtgatgttaacggttcagttcactctcggctggcctttgtacttag

SEQ ID NO: 24593 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24594 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24595 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcagcaacccgctaggacgcacggtgaggctaagcgtccatttcacgctcggctggcctgagtacttag

SEQ ID NO: 24596 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 24597 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattcccacaccggatccctcgagagggatgaagtgttcgtccccaagaagaaatcccacatcaagtggtacggaaagtacctcaacaacccgctagaacgcacggtgatgctaaccgtacagttcacgctcggctggcctttgtacttag

SEQ ID NO: 24598 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24599 - DNA, 358 bp, Artificial
  Mutation in BnaC.FAD2.b introduced by TALE nuclease pair BnFAD2_T02
cctctcctccctcaccatctcccttacctcgcctcgcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtgcttag

SEQ ID NO: 24600 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24601 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24602 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24603 - DNA, 344 bp, Artificial
  Mutation in BnaC.FAD2.b introduced by TALE nuclease pair BnFAD2_T02
cctctctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttttacttag

SEQ ID NO: 24604 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 24605 - DNA, 346 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcattagtacttag

SEQ ID NO: 24606 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24607 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtcggcctcatcttccactccttcctcctcgtcccttacttctcctggaatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24608 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24609 - DNA, 357 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaccgggcctctgggtcatcgcccacgaatgcggccaccacgccttcagcgaccaccagtggctggccgacgccgtgggcctcgtcttcccctccttcctcctcgtccctctcttctcctggaaggccatcgacgcccccattccaacacccgctccctcgagagggatgaagtgttcgtacccaagaaggaatccaacatcaagtggtacggcaaggacctcaacaacccgttggaacgcaccgtgatgttaacggttcagttcactcgcggctggcctgagtacttag

SEQ ID NO: 24610 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagggatgaagtgttcgtccccaagaagaaatccgacatcaagtggtacggcaagtacctcaacaaccctttgggacgcaccgtgatgttaacggttcagtgcactctcggctggcctttgtacttag

SEQ ID NO: 24611 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacagcaagtggtacggaaagtacctcaacaacccgctaggacgcacggtgatgctaaccgtcgagtgcacgctcggctggcctttgtacttag

SEQ ID NO: 24612 - DNA, 315 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcacgctcggctggcctttgtacttag

SEQ ID NO: 24613 - DNA, 454 bp, Artificial
  Mutation in BnaC.FAD2.b introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaggtacatactggaaagcgggcagtgagcgcaacgcaattaatacgcgtaccgctagccaggaagagtgtgtagtaacgcaaaaaggccatacgtcagcagccagcgaggccaccattcaaacaccggatccctcgagagggatgaagtgttcgtccccaagaagaaatccgacagcaagtggtacggaaagtacctcagcaacccgctagaacgcacggtgatgcgaaccgtgtagttcacggtgggctggcctgtgtacttag

SEQ ID NO: 24614 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgaggctaaccgaccagtgcacgctcggctggcctttgtacttag

SEQ ID NO: 24615 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 24616 - DNA, 356 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagacagacatcaagtggtacggcaagtacctcaacaaccctttgggacgcaccgggatgttaacggttcagttcactctcggctagcctgagtacttag

SEQ ID NO: 24617 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaccatcgacgccaccattccaacaccggatccctcgagagggatgaagtgttcgtccccaataagaaatccgacatcaagtggtacggaaagtacctcaacaacccgctaggacgcacggtgatgctaaccgtcgagttcacgctcggctggcctttgtacttag

SEQ ID NO: 24618 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctgtgtacttag

SEQ ID NO: 24619 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgagtctaaccgtccagttcacgctcggctggccttagtacttag

SEQ ID NO: 24620 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccccgccttcagcgactaccagtggctggacgacaccgtcggcctcatcttccactccttcctcctcgtcccttacttctcctggaaacatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 24621 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgccctctgtacttag

SEQ ID NO: 24622 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacaaatgcggccaccacgccatcgacgccaccattccaacaccggatccctcgagagggatgaagtgttcgtccccaagaagaaatccgacatcaagttgtacggaaagtacctcaacaacccgctaggacgcacggtgatgctaaccgtccagttcacgctcggctggcctttgtacttag

SEQ ID NO: 24623 - DNA, 447 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagcaatgacattcttgcaggtatcttcgagccagccacgatcgacattgatctggctatcttgctgacaaaagcaagagaacatagcgttgcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24624 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatacctcgagagggatgaagtgttcgtccccaagaagaaatccgacatcaagtggtacggaaagtacctcaacaacccgctaggacgcacggtgatgctaaccgtccatttcacgctcggctggcctttgtacttag

SEQ ID NO: 24625 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtactag

SEQ ID NO: 24626 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24627 - DNA, 363 bp, Artificial
  Mutation in BnaC.FAD2.b introduced by TALE nuclease pair BnFAD2_T02
cctctcctccctcaccctctacattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctagatcgcacggtgatgctaaccgtcgatttcacgctcgtctggccgttggacttag

SEQ ID NO: 24628 - DNA, 357 bp, Artificial
  Mutation in BnaC.FAD2.b introduced by TALE nuclease pair BnFAD2_T02
cctctcctccctcaccctctcccttacctcgcctggcccctctacttggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24629 - DNA, 351 bp, Artificial
  Mutation in BnaC.FAD2.b introduced by TALE nuclease pair BnFAD2_T02
cctctcctccctcaccctctcccttacctcgcctggcccctctactcggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgtggtacttag

SEQ ID NO: 24630 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggcaagtacctcaacaaccctttgggacgcaccgtgaggttaacggttcatttcactcgcggctggcctgagtacttag

SEQ ID NO: 24631 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctcttggtcatcgcccacgaatgcggccaccacgccttcagcgaccaccagtggctggacgacgccgtgggcctcgtcttccactccttcctcctcgtcccttacttctcctgtaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24632 - DNA, 402 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24633 - DNA, 356 bp, Artificial
  Mutation in BnaC.FAD2.b introduced by TALE nuclease pair BnFAD2_T02
cctctccccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 24634 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcttccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24635 - DNA, 443 bp, Artificial
  Mutation in BnaC.FAD2.b introduced by TALE nuclease pair BnFAD2_T02
cctctcctccctcaccctctcccttacctcgcctggcccctctacttggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaggcgatggccaccacctgctccggggtcaagccgtgggcctggcacagcaccggcaacagcgcctgcaccgtctccagcgcctagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24636 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctgtgtacttag

SEQ ID NO: 24637 - DNA, 324 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24638 - DNA, 324 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 24639 - DNA, 356 bp, Artificial
  Mutation in BnaC.FAD2.b introduced by TALE nuclease pair BnFAD2_T02
cctctcctccctcaccctctcacttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgtttgtccccaagaagaagtcagacatcaagtggtacggcaagtacctcaacaacccgttgggacgcaccgggatgttaacggttcagttcactctcggctggcctttgtacttag

SEQ ID NO: 24640 - DNA, 358 bp, Artificial
  Mutation in BnaC.FAD2.b introduced by TALE nuclease pair BnFAD2_T02
cctccctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24641 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtgggcctcgtcttccactccttcctcctcgtcccttacttctcccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24642 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagggatgaagtgttcgtccccaagaagaaatccgacatcaagtggtacggaaagtacctcaacaaccctctaagacgcacggtggtgctaaccgcccacttcacgctcggctggcctttgtacttag

SEQ ID NO: 24643 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24644 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 24645 - DNA, 379 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttccactccttacttactcgtcccctacaacctgcccatcggccaggccgacgccatcgacgccaccattccaacaccggatccctcgagagggatgaagtgttcgtccccaagaagaaatccgacatcaagtggtacggcaagtacctcaacaacccgttgggacgcaccgtgatgttaacggttcagttcactctcggctggcctgtgtacttag

SEQ ID NO: 24646 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacgccgtcggcctcatcttccactccttcctcctcgtcccttacttctcctggaaccatgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24647 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgccgacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24648 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggtctcacggtgatgctaaccggcgagtgcacgctcggctggcctgtgtacttag

SEQ ID NO: 24649 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaacggttcagttcactctcggctggcctttgtacttag

SEQ ID NO: 24650 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccgcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24651 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24652 - DNA, 354 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24653 - DNA, 343 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtccctacttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 24654 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24655 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 24656 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatcagacatcaagtggtacggcaagtacctcaacaacccgctaggacgcacggtgatgctaaccgtccagttcacgctcggctggcctttgtacttag

SEQ ID NO: 24657 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24658 - DNA, 343 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtgggcctcgtcttccactccttcctcctcgtcccttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24659 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagggttcgtccccaagaagaaatccgacatcaagtggtacggaaagtacctcaacaacccgctaggacgcacggtgatgctaaccgtccagttcacgctcggctggcctgtgtacttag

SEQ ID NO: 24660 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24661 - DNA, 357 bp, Artificial
  Mutation in BnaC.FAD2.b introduced by TALE nuclease pair BnFAD2_T02
cctctcctccctcaccctctcccttacctcgcctggcccctctcctgggcttgccaaggctgcgccctaacgggcctctgggtctccgcccacgaatgcggccaccacgccttcagcgaccaccagtggcttgacgacaccgtcggtctcaccttccactccttcctcctcgtcccttacttctcctggaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24662 - DNA, 371 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcaagtcagaggtggcgaaacccgacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccttgtacttag

SEQ ID NO: 24663 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtacaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24664 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 24665 - DNA, 412 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctgaaccacatcaccaactgcaacggcgccgtgctgtccgtggaggagctccagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24666 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 24667 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagtccacgagtgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgtcctttgtacttag

SEQ ID NO: 24668 - DNA, 273 bp, Artificial
  Mutation in BnaC.FAD2.b introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24669 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccatggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24670 - DNA, 273 bp, Artificial
  Mutation in BnaC.FAD2.b introduced by TALE nuclease pair BnFAD2_T02
cctctcctccctcaccctctcccttacctcgcctggcccctctactgggccggccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgccctttgtacttag

SEQ ID NO: 24671 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatgacgccaccattccaacaccggatccctcgatatggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 24672 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgcaaggacgcacggtgatgctaaccgtccagttcacgctcggctggcctttgtacttag

SEQ ID NO: 24673 - DNA, 291 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagtgactaccagtggcttgacgacaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24674 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcggcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggtctttgtacttag

SEQ ID NO: 24675 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgtttgtccccaagaagaagtcagacatcaagtggtacggaaagtacctcaacaacccgctgggacgcacggtgatgctaaccgtccagttcacgctcggctggcctttgtacttag

SEQ ID NO: 24676 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 24677 - DNA, 349 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24678 - DNA, 358 bp, Artificial
  Mutation in BnaC.FAD2.b introduced by TALE nuclease pair BnFAD2_T02
cctctcctccctcaccctctcccttacctcgcctggcccccctactgggcctgccaaggctgcgtcctaacgggcctctgggtcatcgcccacgaatgcggccaccacgccttcagcgaccaccagtggctggactacgccgtgggcctcgtcttccactccttcctcctcatcccttacttctcctggaagggccatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcatttgtacttag

SEQ ID NO: 24679 - DNA, 357 bp, Artificial
  Mutation in BnaC.FAD2.b introduced by TALE nuclease pair BnFAD2_T02
cctctgctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcgagtggtacggaaagtacctcaacaacccgctaggacgcacggggatgctaaccgtccaggtcacgctcggctggcctgtgtacttag

SEQ ID NO: 24680 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagagatgaagtgttcgtccccaagaagaaatccgacatcaagtggtacggaaagtacctcaacaacccgctaggacgcacggtgatgctaacggttcagttcacgctcggctggcctttgtacttag

SEQ ID NO: 24681 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtaccgcaacaaccggttaggacgcacggtgatgctaaccgtccatttcacgctcggctggcctttgtacttag

SEQ ID NO: 24682 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 24683 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgcctacagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24684 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcctacgaatgcggccaccacgccttcagcgaccaccagtggcttgacgacaccgtcggtctcatcttccactccttcctcctcgtcccttacttctcctgtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24685 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24686 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24687 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtagctggacgacgccgtgggcctcgtcttgcactccttcctcctcgtcccttacttctcctggaagtaccagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcgcgctcggctggcctttgtacttag

SEQ ID NO: 24688 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgaggctaaccgtccaggtcactctcggctggcctttgtacttag

SEQ ID NO: 24689 - DNA, 314 bp, Artificial
  Mutation in BnaC.FAD2.b introduced by TALE nuclease pair BnFAD2_T02
cctctcctcctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcccggtgatgctaaccgtccagttcacgctcggctggcctttgtacttag

SEQ ID NO: 24690 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagccatctacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24691 - DNA, 326 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24692 - DNA, 324 bp, Artificial
  Mutation in BnaC.FAD2.b introduced by TALE nuclease pair BnFAD2_T02
cctctcctccctcaccctctctcctacttcgcctggcttctctactgggcctgccaagggtgcgccctaaccggcgtctgggtcatagcccacgagtgcggccaccacgccttcagcgactaccagtggcttgacgacgccgtgggcctcgtcttccacaccatcgacgccaccattccaacagcggatccctcgagagggatgacgtgttcgtccccaagaagaaatccgacatcaagtggtacggaaattagctcagcaagccgcttagacgcacggtggtgctaaccctccagttcacgctcggctggcctttgtacttag

SEQ ID NO: 24693 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24694 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacactggctccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 24695 - DNA, 379 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttccactccttacttactcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24696 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtcgagttcacgctcggctggcctgtgtacttag

SEQ ID NO: 24697 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcaaggtgatgctaaccgtccagttcacgctcggctggcctttgtacttag

SEQ ID NO: 24698 - DNA, 347 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24699 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccagcagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24700 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24701 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccagtcatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 24702 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 24703 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacgccgtgggcctcgtcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24704 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccacgacgccaccattccaacaccggatccctcgagagagacgaagtgttcgtccccaagaagaaatcagacatcaagtggtacggcaagtacctcaacaacccgctaggacgcacggtgatgctaaccgtccagttcacgctcggctggcctttgtacttag

SEQ ID NO: 24705 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccagcaccggatccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24706 - DNA, 358 bp, Artificial
  Mutation in BnaC.FAD2.b introduced by TALE nuclease pair BnFAD2_T02
cctctccttccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24707 - DNA, 362 bp, Artificial
  Mutation in BnaC.FAD2.b introduced by TALE nuclease pair BnFAD2_T02
cctctcctccctcaccctctcacttacctcgcctggcacctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaagtacagtcatcgacgccaccattccaacaccggatccctcgagagggatgaagtgttcgtccccaagaagaaatccgacatcaagtggtacggaaagtacctcaacaacccgctaggacgcacgggaattctaaccgtgcaggtcacgcgcggctggcctgtgtacgtag

SEQ ID NO: 24708 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 24709 - DNA, 351 bp, Artificial
  Mutation in BnaC.FAD2.b introduced by TALE nuclease pair BnFAD2_T02
cctcccctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24710 - DNA, 343 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttgccatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgcgcggctggcctttgtacttag

SEQ ID NO: 24711 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctattccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24712 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgaggccaccacgccttcagcgaccaccagtggctggacgacgccgtgggcctcgtcttccactccttcctcctcgtcccttactgctcctggaagccagcgacgccaccattccaaccccggatccctcgagagggatgaagtgttcgtccccaagaagaaatcccacatcaagtggtacggaaagtacctcaacaaccctctaggacgcacggggatgctacccgtgccgttcacgctcggctggcctttgtacttcg

SEQ ID NO: 24713 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 24714 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24715 - DNA, 341 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctgtgtacttag

SEQ ID NO: 24716 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24717 - DNA, 356 bp, Artificial
  Mutation in BnaC.FAD2.b introduced by TALE nuclease pair BnFAD2_T02
cctctcctccctcaccctctctcctacttcgcctggcctctctaatgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24718 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaaatcagacatcaagtggtacggaaagtacctcaacaacccgctaggacgcacggtgatgctaaccgtccagttcacgctcggctggcctttgtacttag

SEQ ID NO: 24719 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24720 - DNA, 342 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcagccaccacgccttcagcgaccaccagtggctggacgacgccgtgggcctcgtcttccactccttcctcctcgtcccttacttctcctggaagtaccggataccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24721 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24722 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24723 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 24724 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24725 - DNA, 423 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtagttaggccaccacttcaagaactctgtagcaccgcctacatacctcgctctgctaatcctgttagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctctgtacttag

SEQ ID NO: 24726 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccattacttctcctggaagacaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24727 - DNA, 341 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggcctcatcttccactccttcctcctcgtccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24728 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaactggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24729 - DNA, 363 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24730 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24731 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24732 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgatgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24733 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtgcctcaacaacccgctaggacgcacggtgatgctaaccgtccagttcacgctcggctggcctttgtacttag

SEQ ID NO: 24734 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaataaatccgacatcaagtggtacggaaagtacctcaacaacccgctaggacgcacggtgatgctaaccgtccagttcacgctcggctggcctttgtacttag

SEQ ID NO: 24735 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaattacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacgtag

SEQ ID NO: 24736 - DNA, 401 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtactgcccgctttccagtcgggaaacctgtcgtgccagctgcaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcatttgtacttag

SEQ ID NO: 24737 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24738 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgttaaccgtccagttcacgctcggctggcctttgtacttag

SEQ ID NO: 24739 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 24740 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttcttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24741 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcaactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactaag

SEQ ID NO: 24742 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaagccgacatcaagtggtacggaaagtacctcaacaacccgctagggcgcacggtgatgctaaccggccagttcacgctcggctggcctttgtacttag

SEQ ID NO: 24743 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24744 - DNA, 356 bp, Artificial
  Mutation in BnaC.FAD2.b introduced by TALE nuclease pair BnFAD2_T02
cctctcctccctcaccctctcccttacctcgcctggcccctctactgggccttccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24745 - DNA, 355 bp, Artificial
  Mutation in BnaC.FAD2.b introduced by TALE nuclease pair BnFAD2_T02
cctctcctcctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttttacttag

SEQ ID NO: 24746 - DNA, 350 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24747 - DNA, 357 bp, Artificial
  Mutation in BnaC.FAD2.b introduced by TALE nuclease pair BnFAD2_T02
cctcttctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24748 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaacggttcagttcactctcggctggcctttgtacttag

SEQ ID NO: 24749 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24750 - DNA, 345 bp, Artificial
  Mutation in BnaC.FAD2.b introduced by TALE nuclease pair BnFAD2_T02
cctctcctccctcaccctctcccttacctcgcctggcccctctacttggcctgccaaggctgcgtcctaacgggcctctgggtcatcgcccacgaatgcggccaccacgccttcagcgaccaccagtggctggacgacgccgtgggcctcatcttccactccttcctcctcttcccttacttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24751 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24752 - DNA, 362 bp, Artificial
  Mutation in BnaC.FAD2.b introduced by TALE nuclease pair BnFAD2_T02
cctctcctccctcaccctctcccttacctcgcctgccccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaagtcagacatcaagtggtacggcaagtaccgcaacaaccctttgggacgcaccgtgatgttaacggttcagttcactctcggctggcctttgtacttag

SEQ ID NO: 24753 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcgcggtgatgctatccgtccagttcacgctcggctggcctttgtacttgg

SEQ ID NO: 24754 - DNA, 471 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccagcaataatggtggcaagcaggcgctggagacggtccagcggctgttgccggtgctgtgccaggcccacggcttgaccccccagcaggtggtggccatcgccagcaatacagccatcgacgccaccattccaacaccggatccctcgagagggatgaagtgttcgtccccaagaagaagtcagacatcaagtggtacggcaagtacctaaacaaccctttgggacgcaccgtgatgttaacggttcagttcactctcggctggcctttgtacttag

SEQ ID NO: 24755 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 24756 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaacccttttggacgcaccgtgatgttaacggttcagttcactctcggcttgcctgtgtacttag

SEQ ID NO: 24757 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctgtgtacttag

SEQ ID NO: 24758 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcgggtggcctttgtacttag

SEQ ID NO: 24759 - DNA, 348 bp, Artificial
  Mutation in BnaC.FAD2.b introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcgtcttccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggtgatgctaaccgtgcagttcacgctcggctggcctgtgtacttag

SEQ ID NO: 24760 - DNA, 274 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24761 - DNA, 358 bp, Artificial
  Mutation in BnaC.FAD2.b introduced by TALE nuclease pair BnFAD2_T02
cctctcctccctcaccctctccctttcctcgccttgcccctctcctggtccttccacgtctgcttcctaacgtgcctctgggtcatctcccactaatgcggccaccacgccttcaccgacctccagtggctgttctactccgtgtgcctcgtcttccactccttcctcctcttcccttacttctcctggaacagccatcgacgccaccattccaacaccggatccctcgagagggatgaagtggtcgtccccaagaagaaatccgccatcaagtggtccggaaagtacctcaccaacacgctaggaagcacggtgacgttaacggtgcagttcactctcggctggcatttgtacttag

SEQ ID NO: 24762 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaagactgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggcaagtacctcaacagccctttgggacgcaccgtgatgttaacggttcagttcactctcggctggcctttgtacttag

SEQ ID NO: 24763 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacacagccatcgacgccaccattccaacaccggatccctcgagagggatgaagtgttcgtccccaagaagaaatccgacatcgagtggtacggaaagtacctcaacaacccgctagaacgcacggtgaggctaaccgtccagttcacgctcggctggccttagtacttag

SEQ ID NO: 24764 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggggcgtcctaaccggcgtctgggtcatagcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaccaacccgctaggacgcacggtgatgctaaccgtccagttcacgctcggctggcctttctacttag

SEQ ID NO: 24765 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaaccttccagttcacgctcggctggccttggtacttag

SEQ ID NO: 24766 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactta

SEQ ID NO: 24767 - DNA, 359 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtgcagttcacgctcggctggcctttgtacttag

SEQ ID NO: 24768 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24769 - DNA, 356 bp, Artificial
  Mutation in BnaC.FAD2.b introduced by TALE nuclease pair BnFAD2_T02
cctctcctccctcaccctctctcctacttcgcatggcctctctactgggcctgccagggctgcgtcctaaccggcgtctgggtcatagcccacgagtgcggccaccacgccgtcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctatgacgcacggtgatgctaaccgtccagttcacgctcggctggcctttgtacttag

SEQ ID NO: 24770 - DNA, 324 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24771 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24772 - DNA, 412 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtgcacagcaccggcaacagccgctgggccaggaaccgtaaaaaggccgcgttgcagccatcgacgccaccattccatcaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24773 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaggtacagcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24774 - DNA, 460 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcgatggccaccacctgctggggggtcaagccgtgggcctggcacagcaccgacaacagccgctggaccgtctccagcgcctgcttgccaccgccattgctggcgatgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24775 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgatcggctggcctttgtacttag

SEQ ID NO: 24776 - DNA, 336 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24777 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggcgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24778 - DNA, 469 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtgcgcctttaccaccgctgcgttcggtcaaggttctggaccagttgcgtgagcgcatacgctacttgcatacttgacagcgacggtccctaacgctgccgggtgttggcttagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24779 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24780 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24781 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacacgctaggacgcacggtgatgctaaccgtccagttcacgctcggctggcctttgtacttag

SEQ ID NO: 24782 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtacctcaacaaccctttgggacgcgccgtgatgttaacggttcagttcactctcggctggcctttgtacttag

SEQ ID NO: 24783 - DNA, 346 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaaaacgcacggtgatgctaaccgtccaggtcacgctcggctggcctttgtacttag

SEQ ID NO: 24784 - DNA, 337 bp, Artificial
  Mutation in BnaC.FAD2.b introduced by TALE nuclease pair BnFAD2_T02
cctctcctccctcaccctctcgcttacctcgcctggcccctctactgggcctgccaaggctgcgtcctaacgggcctctgggtcatcccccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggaaagtacctcaacaagccgctaggacgcacggtgatgctaaccgtccagttcacgctcggctggcctttgtacttag

SEQ ID NO: 24785 - DNA, 362 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggccgttgtacttag

SEQ ID NO: 24786 - DNA, 351 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactacttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggccgttgtacttag

SEQ ID NO: 24787 - DNA, 356 bp, Artificial
  Mutation in BnaC.FAD2.b introduced by TALE nuclease pair BnFAD2_T02
ctctcctccctcaccctctcccttacctcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 24788 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctatgacgcgcggtgaggctaaccgtccagttcacgctcggctggcctttgtacttag

SEQ ID NO: 24789 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24790 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaaccctttgggacgcaccgtgatgttaacggttcatttcactctcggctggcctttgtacttag

SEQ ID NO: 24791 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 24792 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccacaattccaacaccggatccctcgagagggatgaagtgttcgtccccaagaagaaatccgacatcaagtggtacggaaagtacctcaacaacccgcgaggacgcacggtgatgctaaccgcccagttcgcgctcggctggcctttgtacttag

SEQ ID NO: 24793 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaagtcagacatcaagtggtacggcaagtacctcaacaaccctttgggacgcaccgtgatgttaactgttcagttcactctcggctggcctttgtacttag

SEQ ID NO: 24794 - DNA, 359 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctgggtacttag

SEQ ID NO: 24795 - DNA, 341 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24796 - DNA, 391 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24797 - DNA, 352 bp, Artificial
  Mutation in BnaC.FAD2.b introduced by TALE nuclease pair BnFAD2_T02
cctctcctccctcaccctctcccttacctcgcctgccccctctactgggcctgccaaggctgcgtcctaacgggcatctgggtcatcgcccacgaatgcggccaccacgccttcagcgaccaccagtggctggacgacgccgtgggcctcgtcttccactccttccgcctcgtcccttacttctcctggcatcgacgccaccattccaacactggctccctcgagagagacgaagtgtttgtccccacgaagaagagagacagcaagtggtacggcaagtacctcaacaacccttggtgactgaccgtgatgttaaccgtccagttcacgctcggctggccttggtacttag

SEQ ID NO: 24798 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaagtcagacatcaagtggtacggcaagtacctcaacaaccctttgggacgcgccgtgatgttaacggttcagttcactctcggctggcctttgtacttag

SEQ ID NO: 24799 - DNA, 412 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctcttggtcatcgcccacgaatgcggccaccacgccttcagcgaccaccagtggctggacgacgccgtgggcctcgtcttccactccttcctcctcgtcccttacttctcctggaagtgctgaaccacatcaccaactgcaacggcgccgtgctgtccgtggaggagctccagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24800 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagagacgaagtgtttgtccccaagaagaagtcagacatcaagtggtacggcaagtacctcaacaaccctttgggacgcaccgtgatgttaacggtgcagttcactctcggctggccgttgtacttag

SEQ ID NO: 24801 - DNA, 444 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcaggcctctgcagtcgacgggcccgggatccgatccaatgaccccccagcaggtggtggccatcgccagcaataatggtggcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccggttcacgctcggctggcctttgtacttag

SEQ ID NO: 24802 - DNA, 454 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgatgttccagattacgctatcgatatcgccgatctacgcacgctcggctacagccagcagcaacaggagaagatcaaaccgaaggttcgttcgagtcatcgacgccaccattccaacactggctccctcgagagagacgaagtgtttgtccccaagaagaagtcagacatcaagtggtacggcaagtacctcaacaaccctttgggacgcaccgtgatgctaaccggccagttcacgctcggctggcctttgtacttag

SEQ ID NO: 24803 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccatcgacgccaccattccaccaccggatccctcgagagggatgaagtgttcgtccccaagaagaaatccgacatcaagtggtacggagagtacctcaacaacccgctaggacgcacggtgatgctaaccgtccagttcacgctcggctggcctttgtacttag

SEQ ID NO: 24804 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgcctccagcgaccaccagtggctggacgacaccgtcggcctcatcttccactccttcctcctcgtcccttacttctcctggaaagccatcgacgccaccattccaacactggctccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 24805 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggtcgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24806 - DNA, 323 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagttgctggacgacgccgtgggcctcgtcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 24807 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaagtcagacatcaagtggtacggcaagtacctcaacaaccctttgggacgcaccgtgatgttaacggtgcagttcactctcggctggcctttgtacttag

SEQ ID NO: 24808 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaagtcagacatcaagtggtacggcaagtacctcaacaaccctttgggacgcaccgtgatgttaacggtgcagttcactctcggctggcctttgtacttag

SEQ ID NO: 24809 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctcaccatccagttcacgctcggctggcctttgtacttag

SEQ ID NO: 24810 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaaatccgacatcaagtggtacggcaagtacctcaacagccctttgggacgcaccgtgatgttaacatttcagttcactctcggctggcctttgtacttag

SEQ ID NO: 24811 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggacccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24812 - DNA, 356 bp, Artificial
  Mutation in BnaC.FAD2.b introduced by TALE nuclease pair BnFAD2_T02
cctctcctccctcaccctctcccttacctcgcctgccccctctactgggccttccaagtctgcgtcctaacgggcctctggttcatcgcccacgaatgctgccaccacgccttcagcgaccaccagtggctggacgacaccgtcggtctcatcttccactccttcctcctcttcccttacttctcctggaagtcatcgacgccaccattccaacaccggctccctcgtgagagacgaagtgtttgtccccaagaagaaatctgacatcaactggtacggaaagtacctcaacgtcacatgaggatgaacggtgatgctaaacgtcaagttcatgctcgggtggcatttgtacttag

SEQ ID NO: 24813 - DNA, 413 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacaggcccacggcttgaccccccagcaggtggtgaccatcgccagcaatggcggtggcagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24814 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24815 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24816 - DNA, 363 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24817 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24818 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaacagtggctggacgacaccgtcggcctcatcttccactccttcctcctcgtcccttacttctcctggaatcgacgccaccattccaacaccggatccctcgagagggatgaagtgttcgtccccaagaagaaatccgacatcaagtggttcggaaagtacctcaacatcccgctaggacgcacggtgatgctaaccgtccagttaacgctcggctggcctttgtacttag

SEQ ID NO: 24819 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacgggaagtacctcaacaacccgctaggacgcacggtgatgctaaccgtccagttcacgctcggctggcctttgtacttag

SEQ ID NO: 24820 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaacgggcctctgggtcatcgcccacgaatgcggccaccacgccttcagcgaccaccagtggctggacgacaccgtcggcctcatcttccactccttcatcctcgtccattacttctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24821 - DNA, 357 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24822 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggccactgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24823 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24824 - DNA, 365 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttcctcctcgtcccttacttctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24825 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24826 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24827 - DNA, 408 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcctttcgttttaattgatgcctggcagttccctattctcgtgttgaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24828 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24829 - DNA, 324 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24830 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24831 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatggagtcgtccggaaagtacctcaacgaccggctaggacgcacggtgagtctaaccgtgcggttgacgcccggctggcctttgtacttag

SEQ ID NO: 24832 - DNA, 357 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24833 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24834 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaaatccgacatcaagtggtacggaaagtacctcaacaacccgctaggacgcacggtaatgctaaccgtccagttcacgcccggctggcctttgtacttag

SEQ ID NO: 24835 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24836 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 24837 - DNA, 355 bp, Artificial
  Mutation in BnaC.FAD2.b introduced by TALE nuclease pair BnFAD2_T02
cctctcctccctcaccctctcccttacctcggctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaatcatcgacgccaccagtccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24838 - DNA, 365 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 24839 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24840 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24841 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24842 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 24843 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgtgcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcgagtggtacggaaagtaactcaacaacccgctaggacgcacggtgatgctaacggtccagttcacgctcggctggcctttgtacttag

SEQ ID NO: 24844 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctgttcatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggccttagtacttag

SEQ ID NO: 24845 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 24846 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24847 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24848 - DNA, 312 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24849 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24850 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24851 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttaattctcctggacatcgacgccaccattccaacactggccccctcgagagagacgaagtgtttgtccccaagaagaaatccgacatcaagtggtacggaaagtacctcaacaacccgctaggacgcacggtgatgctaaccggatagttcacgctcggctagcatttgtacttag

SEQ ID NO: 24852 - DNA, 383 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtttgaccccggagcaggtggtggccagtcatcgacgccaccattccaacactggctccctcgagagagacgaagtgtgtgtccccaagaagaaatccgacatcaagtggtacggaaagtacctcaacaacccgctaggacgcacggtgatgctaaccgtccaggtcacgctcggctggcctttgtacttag

SEQ ID NO: 24853 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggatcgacgccaccattccaacactggctccctcgagagagacgaagtgtttgtccccaagaagaaatccgacatcaagtggtacggaaagtacctcaacaacccgctaggacgcacggtgatgctaaccgtccagttcatgctcggctggcctttgtacttag

SEQ ID NO: 24854 - DNA, 324 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacctgctggggggtcaagccgtgggcctggcacagcaccggcaacagccgcttgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24855 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttctgcgactaccagtggctggacgacaccgtcggcctcatcttccactccttcctcctcgtcccttacttctccttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24856 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgcgggcctcgtcttccactccttcctcctcgtcccttacttctcctggaaccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 24857 - DNA, 350 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24858 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggcatcgacgccaccattccaacactggctccctcgagagagacgaagtgtttgtccccaagaagaagtcagacatcaagtgtacggcaagtacctcaacaacccgctaggacgcacggtgatgctaaccggccagttcacgctcggctggcctttgtacttag

SEQ ID NO: 24859 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24860 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24861 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctagacgacgccgtggccctcgtcttccgctccttcctcctcgtcccttacttctcctggaagtagccatcgacgccaccattccaacaccggatccctcgagagagatgaagtgttcgtccccaagaagaaatccgacatcaagtggtacggaaagtacctcaacaacccgctaggacgcacggtgatgctaacggttcagttcacgctcggctggccgttgtacgtag

SEQ ID NO: 24862 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgagtgcggccaccacgccttcagcgaccaccagtggctggacgacgccgtgggcctcgtcttccactccttcctcctcgtcccttacttctcctggaaagccatcgacgccaccattccaacaccggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24863 - DNA, 322 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctccaccattccaacactggctccctcgagagagacgaagtgtttgtccccaagaagaaatccgacatcaagtggttcggaaagtacctcaacaacccgctaggacgcacggtgatgctaaccgtccagttcacgctcggctggcctttgtacttag

SEQ ID NO: 24864 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaaatccgacatcaagtggtacggaaagtacctcaacaacccgctaggacgcacggtgatgctaacggttcagttcactctcggctggcctttgtacttag

SEQ ID NO: 24865 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaaccctgtgggacgcaccgtgatgttaaccgtccagctccctctcggctggcctttgtacttag

SEQ ID NO: 24866 - DNA, 349 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggccgttgtacttag

SEQ ID NO: 24867 - DNA, 355 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24868 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacacaggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24869 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgaggctaagcgtccagttcaggctcggccggccttagtacttag

SEQ ID NO: 24870 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaacagtcatcgacgccaccattccaacactggctccctcgagagagacgaagtgtttgtccccaagaagaaatccgacatcaagtggtacggaaagtacctcaacaacccgctaggacgtacggtgatgctacccgtccagttcacgctcggctggcctttgtacttag

SEQ ID NO: 24871 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtaggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24872 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgaccccgtcggtctcctcttccactccttcctcctcgtcccttacttctccagtagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24873 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaaatcagacatcgagtggtacggcaagtacctcaacaaccctttgggacgcaccgtgatgttaaccgtacagttcacgctcggctggcctttgtacttag

SEQ ID NO: 24874 - DNA, 344 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttactcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24875 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24876 - DNA, 357 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 24877 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctagtacgcacggtgatgctaaccgtccagttcacgctcggctggcctttgtacttag

SEQ ID NO: 24878 - DNA, 398 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtgccaggcccacggcttgaccccccagcaggtggtggcagtcatcgacgccaccattccaacactggctccctcgagagagacgaagtgtttgtccccaagaagaagtcagacatcaagtggtacggaaagtaccccaacaccccggtaggacgcacggtgatgctacccgtccagttccctctcggctggcctttgtacttag

SEQ ID NO: 24879 - DNA, 356 bp, Artificial
  Mutation in BnaC.FAD2.b introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgaggctaaccgtccagttcacgctcggctggcctttgtacttag

SEQ ID NO: 24880 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaagccgacatcaagtggtacggaaagtacctcaacaacccgctaggacgcacggtgatgctaaccgtccagttcacgctcggctggcctttgtacttag

SEQ ID NO: 24881 - DNA, 356 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaaccctttgggacgcaccgtgatgttaacggtgcagttcactctcggctggcctttgtacttag

SEQ ID NO: 24882 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaccatgacgccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24883 - DNA, 274 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccattccaacaccggatccctcgagaggaatgaagtgttcgtccccaagaagaaatccgacatcaagtggtacggaaagtacctcaacaacccactaggacgcacggtgatgctaaccgtccagttcacgctcggctggcctttgtacttag

SEQ ID NO: 24884 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgtgcctctgggtcatcgcccacgaatgcggccaccacgccttcagcgaccaccagtggctggacgacgccgtgggcctcgttttccactccttcctcctcgtcccttacttctcctggaacagacagccatcgacgccaccattccaacaccggatccctcgagagggatgaagtgttcttccccaagaagaaatccgacatcaagtcgtacgacaagtacctctacaaccccttggacagcaccgtaatgttaacggtgcaggtcactctcggctggccttagtacgtgg

SEQ ID NO: 24885 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24886 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24887 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24888 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactcag

SEQ ID NO: 24889 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcatcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24890 - DNA, 315 bp, Artificial
  Mutation in BnaC.FAD2.b introduced by TALE nuclease pair BnFAD2_T02
cctctcctccctcaccctctcacttacctcgcctggcccctctactgggcctgccaaggctgcgttctaacgggcctctgggtcatcgcccacgaatgcggccaccacgccttcagcgaccaccagtggcggtggcaagcaggcgctggagccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 24891 - DNA, 351 bp, Artificial
  Mutation in BnaC.FAD2.b introduced by TALE nuclease pair BnFAD2_T02
cctctcctccatcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24892 - DNA, 379 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcgtcttccactccttccactccttacttactcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24893 - DNA, 358 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24894 - DNA, 389 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24895 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 24896 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagagatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24897 - DNA, 379 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttccactccttacttactcgtccccgacaacctgcccatcggccaggccgacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24898 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24899 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggttatgctaaccgtccagttcacgctcggctggcctttgtacttag

SEQ ID NO: 24900 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 24901 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagtgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24902 - DNA, 348 bp, Artificial
  Mutation in BnaC.FAD2.b introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24903 - DNA, 391 bp, Artificial
  Mutation in BnaC.FAD2.b introduced by TALE nuclease pair BnFAD2_T02
cctctcctccctcaccctctcccttacctcgcctggcccctctactgggcctcccaacgctgcgtcctaaccggcctctgggtcatcgcccacgcatgcggccaccacgccttcagcgaccaccagtggctggacgacgccgtgcgcctcgtcttccactccttcctcctcgtcccttacttctcctggaagtacaatgttccagattacgctatcgatatcgccggccatcgacgccaccattccaacaccggatccctcgagagggatgaagtgttcgtccccaagaagaaatccgacatcaagtggtacggcacgtatctccgccagcgtctaagacgtacggggatcctccccgccccgctcaccctcggctggcctttgtacttag

SEQ ID NO: 24904 - DNA, 358 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24905 - DNA, 351 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 24906 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtactag

SEQ ID NO: 24907 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggcaagtacctcaacaagcctgtgggacgcaccgtgatgttaaccgttcagttcactctcggctggcctttgtacttag

SEQ ID NO: 24908 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactcttggctggcctttgtacttag

SEQ ID NO: 24909 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcgaccaccacgccttcagcgactaccagtggctggacgacaccgtcggcctcatcttccactccttcctcctcgtcccttacttctcctggaagtatacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24910 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 24911 - DNA, 356 bp, Artificial
  Mutation in BnaC.FAD2.b introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24912 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 24913 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24914 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagccatcgacgccaccattccaacaccggatccctcgagagggatgaagtgttcgtccccaagaagaaagccgacatcaagtggtacggaaagtacctcaacaacccgctaggacgcacggtgatgctaaccgtgaagttcacgctcggctggcctttgtacttag

SEQ ID NO: 24915 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaacccgctaggacgcacggtgatgctaaccgttcagttcacgctcggctggcctttgtacttag

SEQ ID NO: 24916 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24917 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtacctcaacaacccgttgggacgcaccgtgatgttaacggttcagttcactctcggctggcctttgtacttag

SEQ ID NO: 24918 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24919 - DNA, 324 bp, Artificial
  Mutation in BnaC.FAD2.b introduced by TALE nuclease pair BnFAD2_T02
cctctcctccatcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24920 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 24921 - DNA, 400 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaccgcctctccccgcgcgttggcacgacaggtttcccgacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24922 - DNA, 350 bp, Artificial
  Mutation in BnaC.FAD2.b introduced by TALE nuclease pair BnFAD2_T02
cctctcctccctcaccctctctcatacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24923 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtactgag

SEQ ID NO: 24924 - DNA, 355 bp, Artificial
  Mutation in BnaC.FAD2.b introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggccgttgtacttag

SEQ ID NO: 24925 - DNA, 411 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaactggcctctgggtcatcgcccacgaatgcggccaccacgccttcagcgactaccagtggctggacgacgccgtgggcctcgtcttccactccttcctcctcgtcccttacttctcctggaagtacagagcgaggtatgtaggcggtgctacagagttcttgaagtggtggcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24926 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24927 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggtctcatcttccactccttcctcctcgtcccttacttctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24928 - DNA, 365 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcctcctcgtcccttacttctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24929 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaattcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24930 - DNA, 312 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24931 - DNA, 350 bp, Artificial
  Mutation in BnaC.FAD2.b introduced by TALE nuclease pair BnFAD2_T02
cctctcctccctcaccctctcccttacctcgcctggcacctctactgggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctaaccgtgcaggtcacgctcggctggcctgtgtacttag

SEQ ID NO: 24932 - DNA, 359 bp, Artificial
  Mutation in BnaC.FAD2.b introduced by TALE nuclease pair BnFAD2_T02
cctctcctccctcaccctttcccttaccccgcctggcccctctactgggcctgccaaggctgcgtcctaacggccctctgggtaatcgcccacgaatgcggccaccaccccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacaacaagtggtacggaaagtacctcaacaacccgctaggacgcacggtgatgcaaaccgtccagttcacgctcggctggcctttgtacttag

SEQ ID NO: 24933 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 24934 - DNA, 443 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaagttggcattataaaaaagcattgctcatcaatttgttgcaacgaacaggtcactatcagtcaaaataaaatcattatacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttctcgctcggctggccttggtacttag

SEQ ID NO: 24935 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24936 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggctaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgaaatcaagtggtacgtaaagtacctcaacaacccgctaggacgcacggtgatgctaaccgtccaggtcacgctcggctggcctttgtacttag

SEQ ID NO: 24937 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24938 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24939 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaaccagctaggacgcacggtgatgctaaccgtccagttcacgctcggctggcctttgtacttag

SEQ ID NO: 24940 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24941 - DNA, 357 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaacgggcctctgggtcatcgcccacgaatgcggccaccacgccttcagcgaccaccagtggctggacgatgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24942 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24943 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcatcttccactccttcctcctcgtcccttacttctcctggaaagtcatcgacgccaccattccaacaccggatcccacgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24944 - DNA, 352 bp, Artificial
  Mutation in BnaC.FAD2.b introduced by TALE nuclease pair BnFAD2_T02
cctctcctccctcaccctctctcctacttcgtctggcctctcttctcggcctgccaagggtgcgtcccacccggcctctgggtaatcgcccacgagtgcggccaccacgccttcagcgactaccagtggctggacgacaccgtcggcctcatcttccactccttcctcctcgtcccttacttctgaagccatcgacgccaccattccaacaccggatccctcgagagggatgaagtgttcgtccccaagaagaaatccgacatcaagtggtacggaaattacctcaacaacccgctaggacgcacggtgacgctaaccgtctagttcactctcggctggcctttgtacttag

SEQ ID NO: 24945 - DNA, 352 bp, Artificial
  Mutation in BnaC.FAD2.b introduced by TALE nuclease pair BnFAD2_T02
cctctctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcatcttccactccttcctcctcgtcccttacttctcctggaattcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24946 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccgaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24947 - DNA, 398 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacacaccgtcggtctcatcttccactccttcctcctcgtcccttacttctcctggaagtagccgaagtttccaaaaggtcgttgatcaaagctcgccgcgttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24948 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24949 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacgtag

SEQ ID NO: 24950 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24951 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 24952 - DNA, 326 bp, Artificial
  Mutation in BnaC.FAD2.b introduced by TALE nuclease pair BnFAD2_T02
cctctcctccctcaccctctctcctacttcgcctggcccctctactcggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcccgctcggctggcctttgtacttag

SEQ ID NO: 24953 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctcacttctcctggaagccatcgacgccaccattccaacaccggatccctcgagagggatgaagtgttcgtccccaagaagaaatccgacatcaagtggtacggaaagtacctcaacagcccgctaggacgcacggtgatgctaaccgtccagttcacgctcggctggcctttgtacttag

SEQ ID NO: 24954 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 24955 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgcatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacagcaaatgggacggaaagtacctcaacaacccgcgaggacgcaaggtgaagctaaccgtccaggtcacgctcggctggcctttgtacttag

SEQ ID NO: 24956 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaaccccacatcaagtggtacggaaagttcctcaacaacccgctaggacgcccggtgaggctaaccgtccagttcacgctcggctggcctttgtacttag

SEQ ID NO: 24957 - DNA, 352 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24958 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtcttggtcatagcccacgagtgcggccaccacgccttcagcgactaccagtggcttgtcgacaccgtcggtctcatcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24959 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 24960 - DNA, 346 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgccgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24961 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 24962 - DNA, 385 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24963 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggtcgcacggtgatgctaaccgtccagttcacgctcggctggcctttgtacttag

SEQ ID NO: 24964 - DNA, 356 bp, Artificial
  Mutation in BnaC.FAD2.b introduced by TALE nuclease pair BnFAD2_T02
cctctcctccctcaccctctcccttacctcgtctggcccccttactgggcctgccaatgctgcgccctgacgggcctcggggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacgtcaagtacctcaccaaccctgtgggacgcaccgtactgttacccgtccagttccctctcggctggcctttgtacttag

SEQ ID NO: 24965 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 24966 - DNA, 359 bp, Artificial
  Mutation in BnaC.FAD2.b introduced by TALE nuclease pair BnFAD2_T02
cctctcctccctcaccctttcacttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcacttacttctcctggaaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24967 - DNA, 357 bp, Artificial
  Mutation in BnaC.FAD2.b introduced by TALE nuclease pair BnFAD2_T02
cctctcctccctcaccctctctcctacttcgcctggcctctctactgggcctgtcagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24968 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacacctgatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24969 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtcttggtcatagcccacgagtgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24970 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggactacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24971 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagcgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtacttag

SEQ ID NO: 24972 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 24973 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcacggctggcctttgtacttag

SEQ ID NO: 24974 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcagccatcgacgccaccattcaaacaccggatccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 24975 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgcctcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24976 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgtggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24977 - DNA, 362 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagtcatcgacgccaccattccaacaccggatccctcgagagtgatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24978 - DNA, 353 bp, Artificial
  Mutation in BnaC.FAD2.b introduced by TALE nuclease pair BnFAD2_T02
cctctcctccctcaccctttcccttacctcgcctggcccctctactgggcctgtcaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24979 - DNA, 413 bp, Artificial
  Mutation in BnaC.FAD2.b introduced by TALE nuclease pair BnFAD2_T02
cctctcctccctcaccctctctcccacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtggccatcgccagccactgactcgctgcgctcggtcgttcggctgcggcgagcggtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24980 - DNA, 356 bp, Artificial
  Mutation in BnaC.FAD2.b introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24981 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatgtcatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 24982 - DNA, 358 bp, Artificial
  Mutation in BnaC.FAD2.b introduced by TALE nuclease pair BnFAD2_T02
cctctcctccctcaccctctcccttacctcgccttgcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24983 - DNA, 356 bp, Artificial
  Mutation in BnaC.FAD2.b introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24984 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24985 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctaggctggcctttgtacttag

SEQ ID NO: 24986 - DNA, 337 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24987 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggtggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24988 - DNA, 362 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24989 - DNA, 365 bp, Artificial
  Mutation in BnaC.FAD2.b introduced by TALE nuclease pair BnFAD2_T02
cctctcctccctcaccctctcccttacctcgcctggccactctactaggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcctcctcgtcccttacttctcatcgacgcctccattccaacaccggatccctcgagagagatgaagtgttcgtccccaagaagaaatcggacatcgagtggtacggaaaggacctcaacaacccgctagatcgcacggggacgctacccgtccagttcacgcgcggctggcatgtgtacgtag

SEQ ID NO: 24990 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 24991 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccatccagttcacgctcggctggcctttgtacttag

SEQ ID NO: 24992 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaaattacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctctgctggccgttgtacttag

SEQ ID NO: 24993 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 24994 - DNA, 337 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24995 - DNA, 391 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgatgttccagattacgctatcgatatcgccggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 24996 - DNA, 351 bp, Artificial
  Mutation in BnaC.FAD2.b introduced by TALE nuclease pair BnFAD2_T02
cctctcctccctcaccctctcccttacctcgcctggcccctcaactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttgacgctcggctggccgttgtacttag

SEQ ID NO: 24997 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 24998 - DNA, 347 bp, Artificial
  Mutation in BnaC.FAD2.b introduced by TALE nuclease pair BnFAD2_T02
cctctcctccctcaccctctcccttacctcgcctggcccctctactcggcctgccaaggctgcgtcctaacgggcctctgggtcatcgcccacgaatgcggccaccacgccttcagcgaccaccagtggctggacgacgccgtgggcctcgtcttccactccttcctcctcgtcccaatacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 24999 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggatcatcgacgccaccattccaacactggctccctcgagagggatgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 25000 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 25001 - DNA, 365 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcctcctcgtcccttacttctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25002 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 25003 - DNA, 356 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25004 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaattacctcaacaacccgctaggacgcacggtgatgctaaccgtccagtgcacgctcggctggcctttgtacttag

SEQ ID NO: 25005 - DNA, 405 bp, Artificial
  Mutation in BnaC.FAD2.b introduced by TALE nuclease pair BnFAD2_T02
cctctcctccctcaccctctctcctacttcgcctggcctctctactgggcctgtcagggctgcgtcctaaccggcgtctgggtcatagcccacgagtgcggccaccacgccttcagcgactaccagtggctggacgacaccgtcggcctcatcttccactccttcctcctcgtcccttacttctcctggaatgttgccaccgccattgctggcgatggccaccacctgctggggggtcaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25006 - DNA, 350 bp, Artificial
  Mutation in BnaC.FAD2.b introduced by TALE nuclease pair BnFAD2_T02
cctctcctccctccaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttccgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25007 - DNA, 411 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcttcatgaaggtgtacggctacaggggcaagcacctgggcggctccaggaagcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25008 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcacgcgcggctggcctttgtacttag

SEQ ID NO: 25009 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25010 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25011 - DNA, 415 bp, Artificial
  Mutation in BnaC.FAD2.b introduced by TALE nuclease pair BnFAD2_T02
cctctcctccctcaccctctcccttacctcgcctggcccctctactgggcctgccaagcctgcgtcctaacgggcctctgggtcatcgcccacgaatgcggccaccacgccttcagcgactaccagtggcttgacgacaccgtcggtctcatcttccactccttcctcctcgtcccttacttctcctggaagtacatctcaactctcccgccaccgtgagcaaggcctccagagcgcgtgcgccggaccagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25012 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcgaccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25013 - DNA, 383 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagactgagcctttcgttttatttgatgcgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25014 - DNA, 355 bp, Artificial
  Mutation in BnaC.FAD2.b introduced by TALE nuclease pair BnFAD2_T02
cctctcctccctcaccctctcccttacctcgcctggcccctctactcggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaatcatcgacgccaccattccaacactggctccctcgagagggatgaagtgttcgtccccaagaagaaatccggcatcaagtggtacggaaactacctcaacaacccgcgatcacgcacggtgatgctaaccgtccagttcacgctcgtctggcctttgtactcag

SEQ ID NO: 25015 - DNA, 423 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagttaggccaccacttcaagaactctgtagcaccgcctacatacctcgctctgctaatcctgttagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcactctcggctggcctttgtacttag

SEQ ID NO: 25016 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 25017 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 25018 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 25019 - DNA, 409 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcgctctcctgttccgaccctgccgcttaccggatacctgtccgcctttctgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25020 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 25021 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaacgggcctctgggtcatcgcccacgaatgcggccaccacgccttcagcgaccaccagtggctggacgacgccgcgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25022 - DNA, 355 bp, Artificial
  Mutation in BnaC.FAD2.b introduced by TALE nuclease pair BnFAD2_T02
cctctcctccctcaccctctctcctacttcgcctggcctccctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25023 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgagcctctgggtcatcgcccacgaatgcggccaccccgccttcagcgaccaccagtggctggacgacgccgtggtcctcgtcttccactccttcctcctcgtcccttacttatcgacgccaccattccaacaccggatccctcgagagggatgaagtgttcgtccccaagaagaaatccgacctcaagtggtacggaaagcacctcagcatgcctccaggacgcccggtgagtctaaccgtccaattgacgcccggctggcctttgtgcttag

SEQ ID NO: 25024 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25025 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25026 - DNA, 444 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgcaggcctctgcagtcgacgggcccgggatccgatccaatgaccccccagcaggtggtggccatcgccagcaataatggtggcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25027 - DNA, 349 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25028 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25029 - DNA, 363 bp, Artificial
  Mutation in BnaC.FAD2.b introduced by TALE nuclease pair BnFAD2_T02
cctctcctccctcaccctctgccttacctcgcctggccactctactgggcctgccaaggctgcgtcctaaagggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25030 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcgagtggtacggaaagtacctcaacaacccgctaggacgcacggtgatactaaccgtccagttcacgcgcggctggcctttgtacttag

SEQ ID NO: 25031 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25032 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacatcccgctaggacgcacggtgatgctaaccgtccagttcacgctcggctggcctttgtacttag

SEQ ID NO: 25033 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25034 - DNA, 411 bp, Artificial
  Mutation in BnaC.FAD2.b introduced by TALE nuclease pair BnFAD2_T02
cctctcctccctcaccctctcccttacctcgcctggcccctctactcggcctgccaaggctgcgtcctaacgggcctctgggtcatcgcccacgaatgcggccaccacgccttcagcgaccaccagtggctggacgacgccgtgggcctcgtcttccactccttcctccccgtcccttacttctcctggaagtacagagcgaggtatgtaggcggtgctacagagttcttgaagtggtggcctacagccatcgacgccaccattccaacaccggatccctcgagagggatgaagtgttcgtccccaataagaaatccgacatcaagtggtacggaaagtacctcagcaacccgctaggacgcacggtgaggctaaccgtccagttcacgctcggctggcctttgtacttag

SEQ ID NO: 25035 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaattacctcaacaacccgctaggacgcacggtgatgctaaccgtccagttcacgctcggctggcctttgtacttag

SEQ ID NO: 25036 - DNA, 359 bp, Artificial
  Mutation in BnaC.FAD2.b introduced by TALE nuclease pair BnFAD2_T02
cctctcctcccctcaccctctcccttacctcgcctggcccctctactgggcctgccaaggctgcgtcctaacgggcctccgggtcatcgcccacgaatgcggccaccacgccttcagcgaccaccagtggctggacgacgccgtggtccgcgtcttccactccttcctcctcctcccttacttctcctggaagagccatcgacgccaccattccaacaccggatccctcgagagggatgaagtgttcgtccccaagaagaaatctggcatcaagtggtacggaaagtacctcaacatcccgcgaggacggacggtgatgcgaaccgtccagttgacgctcggctggcctttgtacttag

SEQ ID NO: 25037 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtccggcaattacctcaacaaccctgtgggacgcaccgtgatgttaacggttcagttcactctcggctggcctttgtacttag

SEQ ID NO: 25038 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacaccaccattccaacaccggatccctcgagagggatgaagtgttcgtccccaagaagaaatccgacatcaagtggtacggaaagtacctcaacaaccctgtgggacgcaccgtgatgttaacggttcagttcactctcggctggcctttgtacttag

SEQ ID NO: 25039 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctccgggtcatcgcccacgaatgcggccaccacgccttcagcgaccaccagtggctggacgacgccgtgggcctcgtcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25040 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25041 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25042 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25043 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattcaaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25044 - DNA, 370 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttacttactcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25045 - DNA, 315 bp, Artificial
  Mutation in BnaC.FAD2.b introduced by TALE nuclease pair BnFAD2_T02
cctctcctccctcaccctctctactacttcgcctggcatctctactgggcctgccaaggctgcgtcctaccgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgcgcggctggcctttgtacttag

SEQ ID NO: 25046 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactttag

SEQ ID NO: 25047 - DNA, 357 bp, Artificial
  Mutation in BnaC.FAD2.b introduced by TALE nuclease pair BnFAD2_T02
cctctcctccctcaccctctcccttacctcgcctggatccactactcggcctgccaaggctgcgccctaacgggcctctgggtcatcgcccacgaatgcggccaccacgccttcagcgactaccagtggctggacgacaccgtcggcctcatcttccactccttcctcctcgtcccttacttctcctggaaagtcatcgacgcctccattccaacactggctccctcgagagagacgaagtgtttgtccccaagaagaagtcagacatcaagtggtacggcaagtacctcaacaacccggtaggacgcgcggtgtggctatccgtccaattctcgcccggctggcctttgtacttaa

SEQ ID NO: 25048 - DNA, 408 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatatttggattgagagtgaatatgagactctaattggataccgaggggaatttgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25049 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcatcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25050 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25051 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttgtacttag

SEQ ID NO: 25052 - DNA, 273 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25053 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctgacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcccggctggcctttgtacttag

SEQ ID NO: 25054 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25055 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25056 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25057 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25058 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcagccaccacgccttcagcgaccaccagtggctggacgacgccgtgggcctcgtcttccactccttcctcctcgtcccttacttctcctggaagtatcatcgacgccaccattccaacactggctccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 25059 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcatcgacgccaccattccaacaccggatccctcgagagggatgaagtgttcgtccccaagatgaaatccgacatcaagtggtacggaaagtacctcaacaaccctttgggacgcaccgtgatgttaacggttcagttcactctcggctggcctttgtacttag

SEQ ID NO: 25060 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25061 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcacacgagtgcggccaccacgccttcagcgactaccagtggctggacgacaccgtcggcctcatcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttttacttag

SEQ ID NO: 25062 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacg

SEQ ID NO: 25063 - DNA, 324 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25064 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctccccgtcccttacttctcctggaagccatcgacgccaccattccaacaccggatccctcgagagggatgaagtgttcgtccccaagaagaaatccgacatcaagtggtacggaaagtacctcaacatccggctaggacgcacggtgaggctaaccgtccagttcacgctcggctggcctttgtacttag

SEQ ID NO: 25065 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacaccggatccctcgagagggatgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25066 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25067 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 25068 - DNA, 355 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25069 - DNA, 389 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctgacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacaccggatccctcgagagggatgaagtgttcgtccccaagaagaaatccgacatcaagtggtccggaaagtacctcaacaaccccataggacgaaaggtgatgctaaccgtccacttcacgctcggctggcctttgtacctag

SEQ ID NO: 25070 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctagaacgcacggtgatgctaaccgtccagttcacgcgcggctggcctttgtacttag

SEQ ID NO: 25071 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtgcttag

SEQ ID NO: 25072 - DNA, 362 bp, Artificial
  Mutation in BnaC.FAD2.b introduced by TALE nuclease pair BnFAD2_T02
cctctcctccctcaccctctcccttacctcgcctggcctctctactgggcctgccaagggcgcgccctaaccggcgtctgggtcatagcccacgagtgcggccaccacgccttcagcgactaccagtggctggacgacaccgtcggcctcatcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 25073 - DNA, 358 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25074 - DNA, 355 bp, Artificial
  Mutation in BnaC.FAD2.b introduced by TALE nuclease pair BnFAD2_T02
cctctcctccctcaccctctcccttacctcgcctggacacacaactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggaaattacctcaacaacccgctaggacgcacggtgatgctaaccgtccagttcacgctcggctggcctttgtacttag

SEQ ID NO: 25075 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctcccgggcctctgggtcatcgcccacgaatgcggccaccacgccttcagcgaccaccagtggctggacgacgccgtgggcctcgtcttccactccttcctcctcgtcccttacttctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25076 - DNA, 349 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25077 - DNA, 359 bp, Artificial
  Mutation in BnaC.FAD2.b introduced by TALE nuclease pair BnFAD2_T02
cctctcctccctcaccctctcccttacctcgcctggaccctctactgggcctgccaagggtgcgtcctaacgggcctctgggtcatagcccacgagtgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcatggtgatgctaaccgtccagttcacgctcggctggcctttgtacttag

SEQ ID NO: 25078 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttccatcgacgccaccattccaacaccggatccctcgagagggatgaagtgttcgtccccaagaagaaatccgacatcaagtggtacggaaagtacatcaacaacccgctaggacgcacggtgatgctaaccgtccagttcacgctcggctggcctttgtacttag

SEQ ID NO: 25079 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagctaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25080 - DNA, 409 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagcaacagccgctggaccgtctccagcgcctgcttgccgccatcgtggctggcgagtcatcgacgccaccattccaacaccggatccctcgagagggttgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25081 - DNA, 388 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggcagttccctactctcgcgttcgaatacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 25082 - DNA, 344 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacaccggatccctcgagagggatgaagtgttcgtccccaagaagaaatcctacatcaagtggtacggaaagtacctcaacaacccgctaggacgcacggtgatgctaaccgtccagttcacgctcggctggcctttgtacttag

SEQ ID NO: 25083 - DNA, 352 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25084 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25085 - DNA, 347 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25086 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaagactgcgtcctaacgggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25087 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttatccatgacgccaccattccaacaccggatccctcgagagggacgaagtgttcgtccccaagaagaaatcagacatcaagtggtacggcaagtacctcaacaacccgctaggacgcacggtgaggctaaccgtccagttcaagctcggctggcctttgtacttag

SEQ ID NO: 25088 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25089 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctatgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25090 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25091 - DNA, 356 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25092 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25093 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagcgccatcgacgccaccattccaacaccggatccctcgagagggatgaagtgttcgtccccaagaagaaatccgacatcaagtggtacggaaagtacctcaacaacccgctaggacgcacggggatgctaaccgtccaggtgacgctcggctggcctttgtacgtag

SEQ ID NO: 25094 - DNA, 357 bp, Artificial
  Mutation in BnaC.FAD2.b introduced by TALE nuclease pair BnFAD2_T02
cctctcctccctcaccctctctcctacttcgcctcgcctctctactgggcctgccaaggctgcgtcctaacgggcctctgggtcatcgcccacgaatgcggccaccacgccttcatcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25095 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25096 - DNA, 359 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25097 - DNA, 358 bp, Artificial
  Mutation in BnaC.FAD2.b introduced by TALE nuclease pair BnFAD2_T02
cctctcctccctcaccctctctcctacttcgcctggtctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25098 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 25099 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25100 - DNA, 417 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacgtctccagcggctgttgccggtgctgtgccaggcccacggcttgaccccggagcaggtggtggccatcgccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25101 - DNA, 345 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25102 - DNA, 336 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctttgtacttag

SEQ ID NO: 25103 - DNA, 357 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgaccaccagtggctggacgacgccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25104 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcaaccaccagtggctggacgacgccgtgggcctcgtcttccaccccttcctcctcgtcccttacttctcctggaagtcatcgacgccaccattccaacaccggatccctcgagagggatgaagtgttcgtccccaagaagaaatcccacatcaagtggtacggaaagtacctcaacaaccctctaggacgcacggtgagtctaaccgtccagttcccgctcggcgggccttggtacttag

SEQ ID NO: 25105 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25106 - DNA, 356 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25107 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25108 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25109 - DNA, 350 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggaaagtacctcagcaacccgctaggacgcacggtgatgctaaccgtccagttctcgctcgcctggcctttgtacttag

SEQ ID NO: 25110 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccagggatgcgtcctaaccggcgtctgggtcatagcccacgagtgcggccaccacgccttcagcgactaccagtggctggacgacgccgtgggcctcgtcttccactccttcctcctcgtcccttacttctcctggacgccaccattccaacactggctccctcgagagggatgaagtgttcgtccccaagaagaaatccgacatcaagtggtacggaaagtacctcaacaacccgctaggacgcacggtgaggcttaccgtccagttcacgctcggctggccttagtacttag

SEQ ID NO: 25111 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25112 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 25113 - DNA, 274 bp, Artificial
  Mutation in BnaC.FAD2.b introduced by TALE nuclease pair BnFAD2_T02
cctctcctccctcaccctctcccttacctcgcctggcccctctactgggcctgcgaaggctgcgtcctaacgggcctctgggtcatcgcccacgaatgcggccaccacgccttcagcgaccaccattccaacaccggatccctcgagagggatggagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25114 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25115 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25116 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctcactcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25117 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggaaaggacctcaacaacccgctaggacgcacggtgatgctaaccgtccagttcacgctcggctggcctttgtacttag

SEQ ID NO: 25118 - DNA, 274 bp, Artificial
  Mutation in BnaC.FAD2.b introduced by TALE nuclease pair BnFAD2_T02
cctctcctccctcaccctctcccttacctcgcctcgcccctctactgggcctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25119 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatactaaccgtccagttcacgctcggctggccttagtacttag

SEQ ID NO: 25120 - DNA, 291 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25121 - DNA, 362 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtaacagtcatcgacgccaccattccaacaccggatccctcgagagggatgaagtgttcgtccccaagaagaaatccgacatcaagtggtacggaaagtacctcaacaacccgctaggacgcccggtgatgctaaccgtccagttcacgtgcggctggcctttgtacttag

SEQ ID NO: 25122 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25123 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccctcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25124 - DNA, 362 bp, Artificial
  Mutation in BnaC.FAD2.b introduced by TALE nuclease pair BnFAD2_T02
cctctcctccctcaccctctcccttacctcgcctggaccctctaatgggcctgccaaggctgcgtcctaacgggcctctgggtcatcgcccacgaatgctgccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaagaagaaagccgacatcaagtggtacggaaagtacctcaacaacccgcgaggacgcatgatgatgctaaccgtcctgttcacgctcggcgggcctttgtacttag

SEQ ID NO: 25125 - DNA, 350 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25126 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggccggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25127 - DNA, 355 bp, Artificial
  Mutation in BnaC.FAD2.b introduced by TALE nuclease pair BnFAD2_T02
cctctcctccctcaccctctcgcttacctcgcctggcccctctcctgggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcagcaaccggctaggacggagggtgaggcttaccgtccagttgaggctcggctggctttagtgcttag

SEQ ID NO: 25128 - DNA, 355 bp, Artificial
  Mutation in BnaC.FAD2.b introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25129 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25130 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaacccgctaggacgcacggtgatgctaacggttcagttcactctcggctggcctttgtacttag

SEQ ID NO: 25131 - DNA, 315 bp, Artificial
  Mutation in BnaC.FAD2.b introduced by TALE nuclease pair BnFAD2_T02
cctctcctccctcaccctctctcctacttcgcctggcccctctactgggcctgccagggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25132 - DNA, 274 bp, Artificial
  Mutation in BnaC.FAD2.b introduced by TALE nuclease pair BnFAD2_T02
cctctcctccctcaccctctcccttccctcgcctggcccctctactggacctgccaaggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25133 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaacatcgacgccaccattccaacaccggatccctcgagagggatgaagtgttcgtccccaagaagaaatccgacatcaagtggtacggaaagtacctcaacaaccagctaggacgcacggtgattctaaccgtccagttcacgctcggctggcctttgtacttag

SEQ ID NO: 25134 - DNA, 357 bp, Artificial
  Mutation in BnaC.FAD2.b introduced by TALE nuclease pair BnFAD2_T02
cctctcctccctcaccctctcccttacctcgtctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgccatcaagtggtacggaaagtacctcaccgccccgctaggacgcacgggaaagctacccgtccagttcccgctcggctggcctttgtacttag

SEQ ID NO: 25135 - DNA, 358 bp, Artificial
  Mutation in BnaC.FAD2.b introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcatgctcggctggcctttgtacttag

SEQ ID NO: 25136 - DNA, 310 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggctggacgacaccgtcggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25137 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtaccccaacaccccgctaggacgcacggtgatgctaaccgtccagttcacgctcggctggcctttgtacttag

SEQ ID NO: 25138 - DNA, 344 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttactcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25139 - DNA, 409 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcgctctcctgttccgaccctgccgcttaccggatacctgtccgcctttctgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactcgcggctggcctttgtacttag

SEQ ID NO: 25140 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 25141 - DNA, 342 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtccctgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25142 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagccatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcctttttacttag

SEQ ID NO: 25143 - DNA, 358 bp, Artificial
  Mutation in BnaC.FAD2.b introduced by TALE nuclease pair BnFAD2_T02
cctctcctccctcaccctctgccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccaggtcacgctcggctggcctttgtacttag

SEQ ID NO: 25144 - DNA, 444 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcaggcctctgcagtcgacgggcccgggatccgatccaatgaccccccagcaggtggtggccatcgccagcaataatggtggcacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25145 - DNA, 343 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtccctacttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25146 - DNA, 358 bp, Artificial
  Mutation in BnaC.FAD2.b introduced by TALE nuclease pair BnFAD2_T02
cctctcctccctcaccctctcccttacctcgcctagcacctctactgggcctgccaaggctgcgtcctaacgggcctctgggtcatcgcccacgaatgcggccaccacgccttcagcgaccaccagtggctggacgacgccgtgagcctcgtcttccactccttcctcctcgtcccttacttctcctggaagtaccatcgacgccaccattccaacaccggatccctcgagagggatgaagtgttcgtccccaagaagaaagccgacatcaagtggtacggaaagtacctcaacaacccactagcacgcgcggtgatgctaaccgtccagttcacgctcggctggcctttgtacttag

SEQ ID NO: 25147 - DNA, 355 bp, Artificial
  Mutation in BnaC.FAD2.b introduced by TALE nuclease pair BnFAD2_T02
cctctcctccctcaccctctccattacctcgcctggccactctactgggcctgccagggctgcgtcctaaccggcgtctgggtcatagcccacgagtgcggccaccacgccttcagcgactaccagtggctggacgacaccgtcgtcctcatcttccactccttcctactcgtcccttacttctcctggagccatcgacgccaccattccaacaccggatccctcgagagggatgaagtgttcgtccccaagcagaaatccgacctcaagtggtacggaaagtacctcagcagccctctaggccgcgcggtggggctaaccgtccagttgccgctcggctggccttggtaactag

SEQ ID NO: 25148 - DNA, 402 bp, Artificial
  Mutation in BnaC.FAD2.b introduced by TALE nuclease pair BnFAD2_T02
cctctcctccctcaccctctctcctacttcgcctggcctctctactgggcctgccaaggatgcgtcctaaccggcgtctgggtcatagcccacgagtgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaataagaaatccgacatcaagtggtacggaaagtacctcaacaacccgctaggacgcacggtgaggctaaccgtccagttcacgctcggctggccttagtacttag

SEQ ID NO: 25149 - DNA, 292 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25150 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacacgctaggacgcacggtgatgctaaccgtccagttcacgctcggctggcctttgtacttag

SEQ ID NO: 25151 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25152 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggagccatcgacgccaccattccaacaccggatcactcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25153 - DNA, 342 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25154 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagtgggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25155 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacactggctccctcgagagagacgaagtgtttgtccccaagaagaagtcagacatcaagtggtacggaaagtacctcaacaacccgctaggacgcacggtgatgctaaccgtccagttcactctcggctggcctttgtacttag

SEQ ID NO: 25156 - DNA, 329 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactaccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25157 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaactggcctctgggtcatcgcccacgaatgcggccaccacgccttcagcgaccaccagtggctggacgacgccgtgggcctcgtcttccactccttcctcctcgtcccttacttatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 25158 - DNA, 356 bp, Artificial
  Mutation in BnaC.FAD2.b introduced by TALE nuclease pair BnFAD2_T02
cctctcctccccaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25159 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcgtcttccactccttcctcctcgtcccttacttctcctggatgccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtgcttag

SEQ ID NO: 25160 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 25161 - DNA, 357 bp, Artificial
  Mutation in BnaC.FAD2.b introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25162 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacactggctccctcgagagagacgaagtgtttgtccccaagaagaagtcagacatcaagtggtacggcaagtacctcaacaacccgctaggacgcacggttatgctaaccgtccagttctcgctcggctggactttgtacttag

SEQ ID NO: 25163 - DNA, 356 bp, Artificial
  Mutation in BnaC.FAD2.b introduced by TALE nuclease pair BnFAD2_T02
cctctcctccctcaccctctctcctacttcgcccggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25164 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcatcgacgccaccaatccaacaccggatccctcgagagggatgaagtgtgcgtccccaaggagaaatccgacatcaagtggtacggaaagtacctcaacaacccgctaggacgcgcggtgatgctaaccgtccagttcacgctcggttggtctttttccttag

SEQ ID NO: 25165 - DNA, 346 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 25166 - DNA, 315 bp, Artificial
  Mutation in BnaC.FAD2.b introduced by TALE nuclease pair BnFAD2_T02
cctctcctccctcaccctctcgcttacctcgcctggcccctctactgggcctgccaaggatgcgtcctaacgggcctctgggtcatcgcccacgaatgcggccaccacgccttcagcgaccaccaatggcgggggcaagcaggcgctggagccatcgacgccaccattccaacaccggatccctcgagagggatgaagtgttcgtccccaagaagaaatccgacatcaagtggtacggcaagtacctcaacatccctctgggacgcaccgtgatgttaacggttcagttcactctcggctggcctctgtgcttag

SEQ ID NO: 25167 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25168 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 25169 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagtcatcgacgccaccattccaacaccggatccctcgagagggatgaagtgttcgtccccaagaagaaatccgacatcaagtggtacggaaagtaccttaacaacccgctaggacgcacggtgatgctaaccgtccagttcacgctcggcgggcctttgtacttag

SEQ ID NO: 25170 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggtctttgtacttag

SEQ ID NO: 25171 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgttaaccgtccagttcacgctcggctggcctttgtacttag

SEQ ID NO: 25172 - DNA, 447 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggcgatggccaccacctgctccggggtcaagccgtgggcctggcacagccccggcaccagccgctggagggaactaagggcctggcacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25173 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25174 - DNA, 362 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaattacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25175 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctgggacgcacggggaggctaaccgtccagttcacgctcggctggcctttgtacttag

SEQ ID NO: 25176 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25177 - DNA, 314 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25178 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 25179 - DNA, 323 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccgctcgccgcagccgaacgaccgagaagaagtcagacatcaagtggtacggcaagtacctcaacaaccctttggaacgcaccgtgatgttaacggttcagttcactctcgtgtggcctttgtacttag

SEQ ID NO: 25180 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgtggccaccacgccttcagcgaccaccagtggctggacgacgccgtgggcctcgtcttccactccttcctcctcgtcccttacttctcctggaacacagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25181 - DNA, 370 bp, Artificial
  Mutation in BnaC.FAD2.b introduced by TALE nuclease pair BnFAD2_T02
cctctcctccctcaccctctcccttacctcgcctggcccctctactgggcctgccgaggctgcgtcctaacgggcgtctgggtcatagcccacgagtgcggccaccacgccttcagcgactaccagtggctggacgacaccgtcggcctcatcttccactccttcctcctcgtcccttacttctcctggaagggaccgtctccagcgcctgcttgccaccattccaacaccggatccctcgagagggatgaagtgttcgtccccaagaagaaatccgacatcaagtggtacggaaagtacctcaacaacccgcttggacgcacggggatgctaaccgtccagttcacgctcggcgggcctttgtacttag

SEQ ID NO: 25182 - DNA, 344 bp, Artificial
  Mutation in BnaC.FAD2.b introduced by TALE nuclease pair BnFAD2_T02
cctctcctccctcaccctctcccttacctcgcctagcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25183 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 25184 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggcctcatcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25185 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactcgcggctggcctttgtacttag

SEQ ID NO: 25186 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25187 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactcgcggctggcctttgtacttag

SEQ ID NO: 25188 - DNA, 391 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 25189 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatcctacatcaagtggtacggaaagtacctcaacaacccgctaggacgcacggtgatgctaaccgtccagttcacgctcggctggcctgtgtacttag

SEQ ID NO: 25190 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25191 - DNA, 358 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25192 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttccatcgacgccaccattccaacaccggatccctcgagagggatgaagtgttcgtccccaagaagaaatccgacatcaagtggttcggaaagtacctcaacaccccgctaggacgcacggggatgctccccgtccagttcacgcgcggctggcatttgtacttag

SEQ ID NO: 25193 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacaaccagtgggtcggaaagtacctcaacaaccccctaagacgcacggtggttctaaacggccaggtcacgctcggctgggctttgtacttag

SEQ ID NO: 25194 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctagccgtccagttcacgcgcggctggcctttgtacttag

SEQ ID NO: 25195 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcgcggggatgctaaccgtccagttcacgctcggctggccttggtacttag

SEQ ID NO: 25196 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgccatcgacgccaccattccaacaccggatccctcgagagggatgaagtgttcgtccccaagaagaaatccaacatcaagtggtacggaaagtacctcaacaacccgctaggacgcacggtgatgctaaccgtccagttcacgctcggctggcctttgtacttag

SEQ ID NO: 25197 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctgatcgacgccaccattccaacaccggatccctcgagagagacgaagtgtttgtccccaagaagaaatccgacatcaagtggtacggaaagtacctcaacaacccgctaggacgcacggtgatgctaaccgtccagttcacgctcggctggccttggtacttag

SEQ ID NO: 25198 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaaggacctcaacaacccgctaggacgcacggtgatgctaaccgtccagttcacgctcggctggcctttgtacttag

SEQ ID NO: 25199 - DNA, 355 bp, Artificial
  Mutation in BnaC.FAD2.b introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25200 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25201 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcacacgaatgcggccaccacgccttcagcgaccaccagtggctggacgacaccgtcggtctcatcttccactccttcctcctcgtcccttacttctcctggaaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25202 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25203 - DNA, 401 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgaccaccagtggctggacgacgccgtgggcctcgtcttccactccttcctcctcgtcccttacttctcctggaagtactgcccgctttccagtcgggaaacctgtcgtgccagctgcaagccatcgacgccaccactccaacaccggatccctcgagagggatgaagtgttcgtccccaagaagaaatccgacatcaagtggtacggcaagtacctcaacaaccctttgggacgcacggtgatgctaaccgtccagttcacgctcggctggccgttgtacttag

SEQ ID NO: 25204 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcttccccaagaagaaatccgacatcaagtggtacggcaagtacctcaacaaccctttgggacgcaccgggatgttaacggttcagttcactctcggctggcctttgtacttag

SEQ ID NO: 25205 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25206 - DNA, 347 bp, Artificial
  Mutation in BnaC.FAD2.b introduced by TALE nuclease pair BnFAD2_T02
cctctcctccctcacctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacgtttatgctatccggccagttcacgctcggctggcctttgtacttag

SEQ ID NO: 25207 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagacatcgacgccaccattccaacaccggatccctcgagagggatgaagtgttcgtccccaagaagaaatccgacatcaagtggtacggaaagtacctcagcaaccggctaggacgcacggtgatgctaaccgtccagttcacgctcggctggcctttgtacttag

SEQ ID NO: 25208 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaaatccgacatcgagtggtacggaaagtacctcaacaacccgctagaacgcacggtgaggctaaccgtccagttcacgcgcggctggcctgtgtacttag

SEQ ID NO: 25209 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 25210 - DNA, 357 bp, Artificial
  Mutation in BnaC.FAD2.b introduced by TALE nuclease pair BnFAD2_T02
cctctcctccctcaccctctgccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccacaagaagaagtcagacatcaagtggtacggaaagtacctcaacaacccgctaggacgcacggtgagtctaaccgtccagttcacgctcggctggcctttgtacttag

SEQ ID NO: 25211 - DNA, 336 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaacccgctaggacgcacggtgatgctagccgtccagttcacgctcggctggcctttgtgcttag

SEQ ID NO: 25212 - DNA, 360 bp, Artificial
  Mutation in BnaC.FAD2.b introduced by TALE nuclease pair BnFAD2_T02
cctctcctccctcaccctctcccttacctcgcctggcccctctactgggcctgcctaggctgcgtcctaacgggcctctgggtcatcgcccacgaatgcggccaccacgccttcagcgaccaccagtggctggacgacgccgtgggcctcgtcttccactccttcctcctcgtcccttacttctccggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25213 - DNA, 359 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccatcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 25214 - DNA, 358 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25215 - DNA, 360 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctgaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25216 - DNA, 351 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25217 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggctccctcgagagggatgaagtgttcgtccccaagaagaaatccgacatcaagtggtacggaaagtacctcaacaacccgctaggacgcacggtgatgctaacggtccagttcacgctcggctggcctttgtacttag

SEQ ID NO: 25218 - DNA, 351 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 25219 - DNA, 402 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 25220 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25221 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcacgtggtccggcaagtaccccaacgagccgctaggacgcacggtgctgctaaccctcccgttcacgctcggctggcctttgtacttag

SEQ ID NO: 25222 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggttgcaagcaggcgctggagccatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 25223 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaacatcgacgccaccattccaacactggctccctcgagagagacgaagtgtttgtccccaagaagaaatccgacatcaagtggtacggaaagtacctcaacaacccgctaggacgcacggtgatgctaaccgtccagtgcacgctcggctggcctttgtacttag

SEQ ID NO: 25224 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtggctccatcgacgccaccattccaacaccggatccctcgagagggatgaagtgttcgtccccaagaagaaatccgacatcaagtggtacggaaagtacctcaacaacccgctaggacgcacggtgatgctaacggtgcaggtcacgctcggctggcctttgtacttag

SEQ ID NO: 25225 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaagccgacatcaagtggtacggaaagtacctcaacaccccgctaggacgcacggtgatgctaaccgtccaggtcacgctcggctggcctttgtacttag

SEQ ID NO: 25226 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagagacgaagtgtttgtcaccaagaagaagtcagacatcaagtggtacggcaagtacctcaacaaccctttgggacgcaccgtgatgttaacggttcagttcactctcggctggcctttgtacttag

SEQ ID NO: 25227 - DNA, 359 bp, Artificial
  Mutation in BnaC.FAD2.b introduced by TALE nuclease pair BnFAD2_T02
cctctcctccctcaccctctcccttacctcgcctggccaccctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaaatccgacatcaagtggtacggaaagtaccacaacaacccgctaggacgcacggtgatgctaaccgtccatttcacgcgcggctggcctttgtacttag

SEQ ID NO: 25228 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccccgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 25229 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctccttcatcgacgccaccattccaacaatggctccctcgagagagacgaagtggtcgtcccccagaagaaagccgacatcaagtggtacggaaagtacctcaacaaaccgctaggacgcacggtgatgctacccgtccagttcacgctcggctggcctttgtacttag

SEQ ID NO: 25230 - DNA, 358 bp, Artificial
  Mutation in BnaC.FAD2.b introduced by TALE nuclease pair BnFAD2_T02
cctctcctccctcaccctctcccttacctcgcctgacccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgcgcggctggcctttgtacttag

SEQ ID NO: 25231 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25232 - DNA, 326 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25233 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 25234 - DNA, 347 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 25235 - DNA, 357 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggcttcacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctagcacgcacggtgatgctaaccgtccagttcacgctcggctggccttagtacttag

SEQ ID NO: 25236 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25237 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25238 - DNA, 365 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25239 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25240 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggattcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25241 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25242 - DNA, 388 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcaataatggtggcaagcatgcgctggatccaagaagaaatccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25243 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25244 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagccatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 25245 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25246 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgcaaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 25247 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25248 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25249 - DNA, 350 bp, Artificial
  Mutation in BnaC.FAD2.b introduced by TALE nuclease pair BnFAD2_T02
cctctcctccctcaccctctcccttacctagcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25250 - DNA, 407 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttctccagcggctgttgccgccatcgtggctggcgatggccaccacctgagccatcgacgccaccattccaacaccgtatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25251 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatctacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25252 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggactctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25253 - DNA, 357 bp, Artificial
  Mutation in BnaC.FAD2.b introduced by TALE nuclease pair BnFAD2_T02
cctctctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25254 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccactaatgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25255 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttggacttag

SEQ ID NO: 25256 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 25257 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttttacttag

SEQ ID NO: 25258 - DNA, 358 bp, Artificial
  Mutation in BnaC.FAD2.b introduced by TALE nuclease pair BnFAD2_T02
cctctcctccctcaccctctcccttacctctcctggcccccctactgggcctgccaaggctgcgccctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtccggaaagtacctcaccaacccgctaggacgcacggtgatgctaaccgtccatttcacgctcggctggcctttgtacttag

SEQ ID NO: 25259 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggccatagcccacgagtgcggccaccacgccttcagcgactaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaagacgcacggtgatgctaaccgtccagttcacgctcggctggcctttgtacttag

SEQ ID NO: 25260 - DNA, 342 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccggataccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25261 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25262 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgtgcctcgtcttccactccttcctcctcctcccttacttctcctggaagagccatcgacgccaccattccaacaccggatccctcgagagggatgaagtgttcgtccccaagaagaaatccgacatcaagtggtacggaaagtacctcaacatcccgctaggacgctctgtgatgctaaccgtccagttcacgctcggctggcctttgtacttag

SEQ ID NO: 25263 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctggatcatcgcccacgaatgcggccaccacgccttcagcgaccaccagtggctggacgacgccgtgggcctcgtcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 25264 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctgtacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25265 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaaatccgacatcaagtggtacggaaagtacctcaacaccccgctaggacgcacggtgatgctaaccgtccagttcacgctcggctggcctttgtacttag

SEQ ID NO: 25266 - DNA, 357 bp, Artificial
  Mutation in BnaC.FAD2.b introduced by TALE nuclease pair BnFAD2_T02
cctctcctccctcaccctctcccttacctcgcctggccactctactgggcctgccaaggatgcgtcctaaagggcctctgggtcatcgcccacgaatgcggccaccacgcactcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcacgtggcccggaaagtccccctacaccccgctaggacgcacggggctgctactcgtccaggtcactctcggctggcctttgtacttag

SEQ ID NO: 25267 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25268 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25269 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaaacatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25270 - DNA, 359 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 25271 - DNA, 355 bp, Artificial
  Mutation in BnaC.FAD2.b introduced by TALE nuclease pair BnFAD2_T02
cctctcctccctcaccctctcccttacctcgcctggcccctctcatgggcctgccaagactgcgtcctaacgggcctctgggtcatcgcccacgaatgcggccaccacgccttcagcgaccaccagtggctggacgacgccgtggtcctcgtcttccactccttcctcctcgtcccttacttctcctggaatcatcgacgccaccattccaacactggctccctcgagagagacgaagtgtttgtccccaagaagaaatccgacatcaagtggtacggaaaggacctcaacaacccgctagatctcacggtgatgctaaccgtccagttcacgcgcggctggcctttgtacttag

SEQ ID NO: 25272 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccacccccccttcagcgaccaccagtggctagacgacgccgtgggcctcgtcttccactccttcctcctcgtcccttacttctcctggaagtagccatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25273 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgaccaccagtggctggacgacgccgtgggcctcgtcttccactccttcctcctcgtcccttacttctcctggaagttatcagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25274 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacagcccgctaggacgcgcggtgatgctaaccgtccagtgcacgctcggctggccgttgtacgtag

SEQ ID NO: 25275 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccgtatccctcgagagggatgaagtgttcgtccccaagaagaaatccgacatcaagtggttcggaaagtacctcaacaacccgctaggacgcacggtgatgctaaccgtccagttcacgctcggctggcctttgtacttag

SEQ ID NO: 25276 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacatctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25277 - DNA, 352 bp, Artificial
  Mutation in BnaC.FAD2.b introduced by TALE nuclease pair BnFAD2_T02
cctctcctccctcaccctctctcctacttcgcctggcctctctactggacctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 25278 - DNA, 355 bp, Artificial
  Mutation in BnaC.FAD2.b introduced by TALE nuclease pair BnFAD2_T02
cctctcctcctcaccctctcccttacctcgcctggcccctctactgggcctgccaaggctgcgtcctaacgggcctctgggtcatcgcccacgaatgcagccaccacgccttcagcgaccaccagtggctggacgacgccgtgggcctcgtcttccactccttcctcctcgtaccttacttctcctggaagccatcgacgccaccattccaacaccggatccctcgagagggatgaagtgttcgtccccaagaagaaatccgacatcaagtggtacggaaaggacctcaacaacccgctaggacgcacggggatgctaaccgtccatgtcacgcgcgggtggcctttatacttag

SEQ ID NO: 25279 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25280 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 25281 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25282 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25283 - DNA, 354 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25284 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaaatgcgacatcaagtggtacggaaagtacctcaacaacccgctaggacgcacggtgatgctaaccgtccagttcacgctcggctggcctttgtacttag

SEQ ID NO: 25285 - DNA, 356 bp, Artificial
  Mutation in BnaC.FAD2.b introduced by TALE nuclease pair BnFAD2_T02
cctctcctccctcaccctctcccttacctcgcctgccccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 25286 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 25287 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25288 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagttgtacggaaagtacctcaacaacccgctaggacgcacggtgatgctaaccgtccagttcacgctcggctggcctttgtacttag

SEQ ID NO: 25289 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25290 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25291 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25292 - DNA, 359 bp, Artificial
  Mutation in BnaC.FAD2.b introduced by TALE nuclease pair BnFAD2_T02
cctctcctccctcaccatctcccttacctcgcctggcccctctactgggcctgccaaggctgcgtcctaacgggcctctgggtcatcgcccacgaatgcagccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25293 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaaccctttgggacgcaccgtgatgttaacggttcatttcactctcggctggcctttgtacttag

SEQ ID NO: 25294 - DNA, 310 bp, Artificial
  Mutation in BnaC.FAD2.b introduced by TALE nuclease pair BnFAD2_T02
cctctcctccctcaccctctcccttacctcgcctggccccccttctgggcctgccaaggctgcgccctaacgggcctctgggtcatcgcccacgaatgcggccaccacgccttcagcgaccaccagtggcttgacgacaccgtcggtcatcgacgccaccattccaacaccggatccctcgagagggatgaagtgttcgtccccaagaagaaatccgacatcaagtggtacggaaagtacctcaacaaccccgtaggacgcacggaaaagccaaccgtccatggcacgctcggctggccgttgtacttag

SEQ ID NO: 25295 - DNA, 354 bp, Artificial
  Mutation in BnaC.FAD2.b introduced by TALE nuclease pair BnFAD2_T02
cctctcctccccaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25296 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgcgcggctggcctttgtacttag

SEQ ID NO: 25297 - DNA, 318 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 25298 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcccttgtacttag

SEQ ID NO: 25299 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacatcgacgccaccattccaacaccggatccctcgagagggatgaagtgttcgtccccaagaagaaacccgacatcaagtggtacggaaagtacctcaacaacccgctaggacgcacggtgatgctaaccgtccagttcacgctcggctggcctttgtacttag

SEQ ID NO: 25300 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgatgctatccgtccagttcacgctcggctggcctttgtacgtag

SEQ ID NO: 25301 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25302 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtatggcaagtacctcaacaaccctttgggacgcaccgggatgttaacggttcagttcactctcggctggcctttgtacttag

SEQ ID NO: 25303 - DNA, 336 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 25304 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcctccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtacttag

SEQ ID NO: 25305 - DNA, 395 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccgccggagtaggccttggcgtccacgatcacgccgtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25306 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaaaacccacatccagtggtacggaaagtacctcaacaacccgctaggacgcccggtgatgctaaccgtccatttcacgctcggctggcctttgtacttag

SEQ ID NO: 25307 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttagtccccaagaagaaatccgacatcaagtggtacggaaagtacctcaacaacccgctaggacgcacggtgatgctaaccgtccagttcacgctcggctggcctttgtacttag

SEQ ID NO: 25308 - DNA, 355 bp, Artificial
  Mutation in BnaC.FAD2.b introduced by TALE nuclease pair BnFAD2_T02
cctctcctccctcaccctctcccttacctcgcctcaccactctactgggcctgccaaggctgcgtcctaacgggcctctgggtcatcgcccacgaatgcggccaccaagccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaaggacctcaacaacccgctaggacgcacggtgatgctaaccgtccagttcacgctaggctggcctttgtacttag

SEQ ID NO: 25309 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 25310 - DNA, 350 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25311 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25312 - DNA, 336 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactgcttcctcctcgtcatcgacgccaccattccaacactggctccctcgagagagacgaagtgttggtccccaagaagaagtcagacatcaagtggtacggaaagtacctcaacaacccgctaggacgcgcggtgatgctagccgtccagttcacgcgcggctggcctttgtacttag

SEQ ID NO: 25313 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgcgaaccgtccagttcacgctcggctggcctttgtacttag

SEQ ID NO: 25314 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccatacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25315 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25316 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaggaagaaacccgccaccaggtgttacggaagttcccccaccaccccgcaaggacgctcgttgatgctaaccgtccagtccccccgcggttggcctttttattag

SEQ ID NO: 25317 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttagc

SEQ ID NO: 25318 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25319 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaaggacctcaacaacccgctaggacgcacggtgatgctaaccgtccagttcacgcctggctggcctttgtacttag

SEQ ID NO: 25320 - DNA, 348 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctccatcgacgccaccattccaacactggctccctcgagagggatgaagtgttcgtccccaagaagaaatccgacatcaagtggtacggaaagtacctcagcagcgccctaggacgcgcggtgatgctaaccgtccagtgcgcgctcggcgggcctttgtgcttag

SEQ ID NO: 25321 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgatgttccagattacgctatcgatatcgccggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 25322 - DNA, 343 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtgtctggacgacgccgtgggcctcgtcttccactccttcctcctcgtccctacttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25323 - DNA, 291 bp, Artificial
  Mutation in BnaC.FAD2.b introduced by TALE nuclease pair BnFAD2_T02
cctctcctccctcaccctctcccttacctcgcctgtacccactactgggcctgccaaagctgcgtcctaacgggcctctgggtcatcgcccacgaatgcggccaccacgccttcagcgactaccagtggcttgacgacaccattccaacactggctccctcgagagagacgaagtgtttgtccccaagaagaagtcagacatcaagtggtacggcaagtacctcaacaacccgctaggacgcacggtgatgctaaccgtccagccctctctcggctggcctttgtacttag

SEQ ID NO: 25324 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtaccgcaacaacccgctaggacgcacggtgatgctaaccgtccagttcacgctcggctggcctttgtacttag

SEQ ID NO: 25325 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggccctttgtacttag

SEQ ID NO: 25326 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggatgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25327 - DNA, 352 bp, Artificial
  Mutation in BnaC.FAD2.b introduced by TALE nuclease pair BnFAD2_T02
cctctcctccctcaccctctgccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25328 - DNA, 356 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 25329 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25330 - DNA, 402 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25331 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 25332 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25333 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaagtcagccatcaagtggtacggcaagtacctcaacaaccctttgggacgcaccgtgatgttaacggttcagttcactctcggctggcctatgtacttag

SEQ ID NO: 25334 - DNA, 356 bp, Artificial
  Mutation in BnaC.FAD2.b introduced by TALE nuclease pair BnFAD2_T02
cctctcctccctcaccctctcccttacctcgcctggcccctccactgggcctgccaaggctgcgtcctaacgggcctctgggtcatcgcccacgaatgcggccaccacgccatcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtggttctaaccgtccagttcacgctcggctggcctttgtacttag

SEQ ID NO: 25335 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacaccggatccctcgagagtgatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25336 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgaaatcaagtggtacggaaagtacctcaacaacccgctaggacgcacggtgatgctaaccgtccagttcacgctcggctggcctttgtacttag

SEQ ID NO: 25337 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtacttag

SEQ ID NO: 25338 - DNA, 351 bp, Artificial
  Mutation in BnaC.FAD2.b introduced by TALE nuclease pair BnFAD2_T02
cctctcctccctcaccctttcccttacctcgcctggcacctctcctgggcctgccaaggatgcgtcctaacgggcctctgggtcatcgcccacgaatgaggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggcttgcctttgtacttag

SEQ ID NO: 25339 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcccggtgatactaaccgtccagttcacgctcggctggcctttgtactcag

SEQ ID NO: 25340 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcacccacgaatgcggccacctcgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25341 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctgggacgcacggtgatgctaaccgtccagttcacgctcggctggcctttgtacttag

SEQ ID NO: 25342 - DNA, 361 bp, Artificial
  Mutation in BnaC.FAD2.b introduced by TALE nuclease pair BnFAD2_T02
cctctcctccctcaccctctccctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctaaacaacccgctaggacgcacggtgatgctaaccgtccagttcacgctcggctggcctttgtacttag

SEQ ID NO: 25343 - DNA, 329 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactaccagtcatcgacgccaccattccaacaccggatccctcgagagggatgaagtgttcgtccccaagaagaaatcctacatcaagtggtacggaaagtacctcaacaacccgctaggacgcacggtgatgctaaccgtccagttcacgctcggctggcctttgtacttag

SEQ ID NO: 25344 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25345 - DNA, 387 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctttgcctggcacagcaccggcaacagccgctggaccgtctccagctgtcatcgacgcaaccattccaacaccggatccctcgagagggatgaagtgttcgtccccaagaagaagtcagacatcaagtggtacggcaagtacctcaacaaccctttgggacgcaccgtgatgttaaccgtccagttcacgctcggctggcctttgtacttag

SEQ ID NO: 25346 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25347 - DNA, 333 bp, Artificial
  Mutation in BnaC.FAD2.b introduced by TALE nuclease pair BnFAD2_T02
cctctcctccctcaccctttcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcatcgacgccaccattccaacaccggatccctcgagagggatgaagtgttcgtccccaagaagaagtcagacatcaagtggtacggcaagtacctcaacagccctttgggacgcaccgtgatggtaacggttcagtccactctcggcgggccttttgacttag

SEQ ID NO: 25348 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25349 - DNA, 356 bp, Artificial
  Mutation in BnaC.FAD2.b introduced by TALE nuclease pair BnFAD2_T02
cctctcctccctcaccctatcccttacctcgcctcccccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcgggtggcctttgtacttag

SEQ ID NO: 25350 - DNA, 395 bp, Artificial
  Mutation in BnaC.FAD2.b introduced by TALE nuclease pair BnFAD2_T02
cctctcctccctcaccctctcccttacctcgcctggcccctctactgggccagccaaggctgcgtcctaacgggcctctgggtcatcgcccacgaatgcggccaccacgccttcagcgaccaccagtgactggacgacgccgtgggcctcgtcttccactccttcctcctcgtcccttacttctcctggaagttgaccccccagcaggtggtggccatcgccagccaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25351 - DNA, 401 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtactgcccgctttccagtcgggaaacctgtcgtgccagctgcaagccatcgacgccaccattccaacaccggatccctcgagagggatgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25352 - DNA, 389 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25353 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtccttacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25354 - DNA, 359 bp, Artificial
  Mutation in BnaC.FAD2.b introduced by TALE nuclease pair BnFAD2_T02
cctctcctccctcaccctctctcctacttcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25355 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattcgacgccaccattccaacaccggatccctcgagagggatgaagtgttcgtccccaagatgaaatccgacatcaagtggtacggaaagtacctcaacaacccgctaggacgcacggtgatgctaaccgtccagttcacgctcggctggcctttgtacttag

SEQ ID NO: 25356 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcccggctggcctttgtacttag

SEQ ID NO: 25357 - DNA, 353 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25358 - DNA, 358 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25359 - DNA, 362 bp, Artificial
  Mutation in BnaC.FAD2.b introduced by TALE nuclease pair BnFAD2_T02
cctctcctccctcaccctgtcccttacctcgcctggctcctctactcggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaataagaaatccgacatcaagtggtacggaaactacctcaacaaccctctaggacgcacggtgggtctaaccgtccaggtcacgctcggcgggcctttgtacttag

SEQ ID NO: 25360 - DNA, 385 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcaataatggtggcaagcaggcgctggatccatcgacgccaccattccaacaccggatccctcgagagggatgaagtgttcgtccccaagaagaaatccgacatcaagtggtacggcaactacctcaacaaccctttgggacgcaccgtgatgttaacggttcagttcactctcggctggcctttgtacttag

SEQ ID NO: 25361 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgaggctaaccgtccaggtcacgctcggctggcctttgtacttag

SEQ ID NO: 25362 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25363 - DNA, 291 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccatcagcgactaccagtggcttgacgacaccgtcggaagactggctccctcgagagagacgaactgtttgtccccaagaagaaatccgacatcaagtggtacggaaagtacctcaacaacccgctaggacgcacggtgatgctaaccgtccagttcacgctcggctggcctttgtacttag

SEQ ID NO: 25364 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagtaacagtcatcgacgccaccattccaacaccggatccctcgagagggatgaagtgttcgtccccaagaagaaatccgccatcaagtggtacggaaagtacctcaacaaccctctaggacgcacggtgatgctaaccgtccagtgcacgctcggctggccgttgtacttag

SEQ ID NO: 25365 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 25366 - DNA, 315 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25367 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25368 - DNA, 351 bp, Artificial
  Mutation in BnaC.FAD2.b introduced by TALE nuclease pair BnFAD2_T02
cctctcctccctcaccctctgtcctacttcgcctggcctctctactgggcctgccagggctgcgtcctaaccggcgtctgggtcatcgcccacgaatgcggccacaacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaagccgacatcaagaagtacgaaaggtgcctcaacaacccgctgggacgcacggtgatactaaccgtccagttcacgctcggctagcctttgtacttag

SEQ ID NO: 25369 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctagccatcgacgccaccattccaacaccggatccctcgagagggatgaagtgttcgtccccaagaaggaatccgacatcaagtggtacggaaagtacctcaacaacccgctaggacgcacggtgatgctaaccgtccagttcacgctcggctggcctttgtacttag

SEQ ID NO: 25370 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttggacttag

SEQ ID NO: 25371 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctcttggtcatcgcccacgaatgcggccaccacgccttcagcgaccaccagtggctggacgacgccgtgggcctcgtcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25372 - DNA, 318 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 25373 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggatggcctttgtacttag

SEQ ID NO: 25374 - DNA, 358 bp, Artificial
  Mutation in BnaC.FAD2.b introduced by TALE nuclease pair BnFAD2_T02
ccttcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25375 - DNA, 324 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcacgctcggctggcctttgtacttag

SEQ ID NO: 25376 - DNA, 355 bp, Artificial
  Mutation in BnaC.FAD2.b introduced by TALE nuclease pair BnFAD2_T02
cctctcctccctcaccctctgccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 25377 - DNA, 355 bp, Artificial
  Mutation in BnaC.FAD2.b introduced by TALE nuclease pair BnFAD2_T02
cctctcctccctcaccctctcacttacctcgcctgtcccctctcctgggcctgccaaggatgcgtcctcacgggcctctgggtcatcgcccacgaatgcggccaccccgccttcagcgaccaccagtggctggacgacgccgtgggcctcgtcttccactccgtcctcctcgtcccttccttctcctgtaaccatcgacgccaccattccaacaccggatccctcgagagggatgaagtgtccgtccccaagaagaaacccgacatgaagtggtacggaaagtacctcaacaagcgtctaggacggacggtggggcaaagcgtccaggtgacgctcggagggcctttgtgattag

SEQ ID NO: 25378 - DNA, 357 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25379 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaagggcctctgggtcatcgcccacgaatgcggccaccaagccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctctgctggcctttgtgcttag

SEQ ID NO: 25380 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacagcccgctaggacgcacggtgatgctaaccgtccagttcactctcggctggcctttgtacttag

SEQ ID NO: 25381 - DNA, 362 bp, Artificial
  Mutation in BnaC.FAD2.b introduced by TALE nuclease pair BnFAD2_T02
cctctcctccctcaccctatcccttacctcgcctcgcccctctactgggcctgccaaggctgcgtcctaacgggcctctgggtcatcgcccacgaatgcggccaccacgccttcagcgaccaccagtggctggacgaccccgtgggcctcgtcttccactccttcctcctcgtcccttacttctcctggaagtcacagccatcgacgcctccattccaacaccagatccctcgagagggatgaagtgttcgtccccaagaagaaatccgacatcaagtggtacggaaagtccctcaacaacccgctaggacgcacggtgatgctaaccgtccagttcacgctcggctggccattgtacatag

SEQ ID NO: 25382 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25383 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggccgcacggggatgctaaccgtccagttcacgctcggctggcctttgtacttag

SEQ ID NO: 25384 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggcgggcctttgtacttag

SEQ ID NO: 25385 - DNA, 412 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctgaaccacatcaccaactgcaacggcgccgtgctgtccgtggaggagctccagccatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 25386 - DNA, 402 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25387 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccttccagtgcacgctctgctggcctttgtacttag

SEQ ID NO: 25388 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25389 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgaccaccagtggctggacgacgccgtgggcctcgtcttccactccttcctcctcgtcccttacttctcctggaaaccaacgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgacttag

SEQ ID NO: 25390 - DNA, 356 bp, Artificial
  Mutation in BnaC.FAD2.b introduced by TALE nuclease pair BnFAD2_T02
cctctcctccctcaccctctcccttacctcgcgtggccaccctactgggcctgccaaggctgcgccctaaccgccgtctgggtcatagcccacgagtgcggccaccacgccttcagcgaccaccagtggctggacgacaccgtcggtctcatcttccactccttcctcctcgtcccttacttctcctggaaggccatcgacgccaccattccaacaccggatccctcgagagggatgaagtgttcgtccccaagaagaaatccgacatcaagtggtacggaaattaccgcaacaacccgctaggacgcacggtgagcctaaccgtccagttcccgctcggctggcctttgtactag

SEQ ID NO: 25391 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25392 - DNA, 344 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcatcgacgccaccattccaacaccggatccctcgagagggatgaagtgttcgtccccaagaagaaatccgacatcaagtggtacggaaagtacctcaacaaccctttgggacgcaccgtgatgtgaacggttcagttcacgctcggctggcctttgtacttag

SEQ ID NO: 25393 - DNA, 348 bp, Artificial
  Mutation in BnaC.FAD2.b introduced by TALE nuclease pair BnFAD2_T02
cctctcctccctcaccctttcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacgccaccattccaacaccggatccctcgagagggatgaagttttcgtccccaagaagaaatccgacatcaagtggtacggaaagtacctcaacaacccgctaggacgcacggtgatgctaaccgtccagttcacgctcggctggcctttgtacttag

SEQ ID NO: 25394 - DNA, 357 bp, Artificial
  Mutation in BnaC.FAD2.b introduced by TALE nuclease pair BnFAD2_T02
cctctcctccctcaccctctcacttacctcgcctggcacatctactgggcctgccaaggctgcgtcccaaccggcgtctggataatagcccacgagtgaggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcttccccaagaagaaatccgacatcaagtggtacggaaagtacctcaacaacccgttagaacgcacggtaatgctaaccgtccaggtcacgttcggctggcctttatacttag

SEQ ID NO: 25395 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgagcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25396 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggactctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacaccggatccctcgagagggatgaagtgttcgtccccaagaagaaatccgacataaagtggtacggaaagtacctcaacaacccgctaggacgcacggtgatgctacccgtccagttcccgctcggctggcctttgtacttag

SEQ ID NO: 25397 - DNA, 475 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacgcgcacatcgttgcgttaagccaacacccggcagcgttagggaccgtcgctgtcaagtatcaggacatgatcgcagcgttgccagatgccaactttgtacaaaaaagcaggcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25398 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacaaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25399 - DNA, 356 bp, Artificial
  Mutation in BnaC.FAD2.b introduced by TALE nuclease pair BnFAD2_T02
cctctcctccctcaccctgtctcctacttcgcctggcctctccactgggcctgccaaggatgcgtcctaacaggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacatgccgctaggacgcacggtgatgcaaaccgtccagttcacgctcggctggcctttgtgcttag

SEQ ID NO: 25400 - DNA, 356 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 25401 - DNA, 450 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacggtcgggctgaacggggggttcgtgcacacagcccagcttggagcgaacgaccttgacggatggccttctgcttagtttgatgcctggcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25402 - DNA, 357 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25403 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 25404 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgccgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25405 - DNA, 357 bp, Artificial
  Mutation in BnaC.FAD2.b introduced by TALE nuclease pair BnFAD2_T02
cctctcctccctcaccctttcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccgtcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttatacttag

SEQ ID NO: 25406 - DNA, 357 bp, Artificial
  Mutation in BnaC.FAD2.b introduced by TALE nuclease pair BnFAD2_T02
cctctcctccctcaccctatcccttacctcgcctggcccctctactgggcctgccaaggctgcgtcctaacgggcctctgggtcatcgcccacgaatgtggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25407 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25408 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25409 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctattccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25410 - DNA, 357 bp, Artificial
  Mutation in BnaC.FAD2.b introduced by TALE nuclease pair BnFAD2_T02
cctctcctccctcaccctctcccttacctcgcctggcacctctcctaggcctgccaaggctgcgtcccaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccttgaaggtcacgctcggctgccctttgtacttag

SEQ ID NO: 25411 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25412 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcttgcctttgtacttag

SEQ ID NO: 25413 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtggacctcgtcttccactccttcctcctcgtcccttacttctcctggagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 25414 - DNA, 389 bp, Artificial
  Mutation in BnaC.FAD2.b introduced by TALE nuclease pair BnFAD2_T02
cctctcctccctcacccactcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25415 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 25416 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaacggcgagctttgatcaacgaccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25417 - DNA, 358 bp, Artificial
  Mutation in BnaC.FAD2.b introduced by TALE nuclease pair BnFAD2_T02
cctctcctccctcaccctctcccttacctcgcctggcccctcccctcggcctgcaaaggctgcgtcctaacgggcctctgggtcatcgcccacgaatgcggccaccacgccttcagcgaccaccagtggctggacgacgccgtggtcctcgtcttccactccttcctcctcgtcccttacttctcctggaacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 25418 - DNA, 352 bp, Artificial
  Mutation in BnaC.FAD2.b introduced by TALE nuclease pair BnFAD2_T02
cctctcctccctcaccctttcacttacctcgcctgtcccctctactgggcctgccaaggctgcgtcctacccgccctctgggtcatcgcccacgaatgcggccaccacgccttcagcgaccaccagtggctggacgacgccgtgggcctcgtcttccactccttccaccgcgtcccttacttctcctggaatcgacgccagcattccaacaccggatcccgcgagagggaggaagtggtcgtccccaagaagaaatcggacatcaagtggtacggaaagtagctcaacaacccggtaggacgcacggtgaagctaaccgttcagtgcacgctcggcttgcccttgtacttag

SEQ ID NO: 25419 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25420 - DNA, 344 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttactcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25421 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 25422 - DNA, 357 bp, Artificial
  Mutation in BnaC.FAD2.b introduced by TALE nuclease pair BnFAD2_T02
cctctcctccctcaccctttcccttacctcgcctggcccctctactgggcctgccaaggctgcgtcctaacgggcctctgtgtcatcgcccacgaatgcggccaccccgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaacccgttgggacgcaccgggatgttaacggttcagttcactctcggctggcctttgtacttag

SEQ ID NO: 25423 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctctgctggcctttgtacttag

SEQ ID NO: 25424 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggttcggaaagtacctcaacatgccgctaggacgcacggtgaggctaaccgtccagttcacgctcggcgggcctttgtacttag

SEQ ID NO: 25425 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25426 - DNA, 353 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25427 - DNA, 357 bp, Artificial
  Mutation in BnaC.FAD2.b introduced by TALE nuclease pair BnFAD2_T02
cctctcctccctcaccctctctcctacttcgccttgcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25428 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtacacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25429 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcacccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25430 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggcgggcctttgtacttag

SEQ ID NO: 25431 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcataacgggcctctgggtcatcgcccacgaatgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25432 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25433 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcccctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtatggaaagtacctcaacaacccgctaggacgcacggtgatgctaaccgtccagttcacgctcggctggcctttgtacttag

SEQ ID NO: 25434 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccactccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25435 - DNA, 273 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25436 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggcaagtacctcaacaaccctttgggacgcaccgtgatgtcaacggttcagttcactctcggctggcctttgtacttag

SEQ ID NO: 25437 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 25438 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25439 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccatacttctcctggaaagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25440 - DNA, 357 bp, Artificial
  Mutation in BnaC.FAD2.b introduced by TALE nuclease pair BnFAD2_T02
cctctcctccctcaccctcacacttacctcgcctggcccctcaactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggactcacggtgatgctaaccgtccagttcacgctcggctggcctttggacttag

SEQ ID NO: 25441 - DNA, 408 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagttctccagcgcctgcttgccgccatcgtggctggcgatggccaccacctgagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25442 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 25443 - DNA, 384 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgggcgctcggtcgttcggctgcggcgagcggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25444 - DNA, 357 bp, Artificial
  Mutation in BnaC.FAD2.b introduced by TALE nuclease pair BnFAD2_T02
cctctcctccctcaccctctcccttacctcgcctggcaactctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 25445 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25446 - DNA, 347 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatccatgacgccaccattccaacaccggatccctcgatagggacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25447 - DNA, 349 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgttggcctcgtcttccactccttcctcctcgtcccttacttctcctgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25448 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25449 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25450 - DNA, 357 bp, Artificial
  Mutation in BnaC.FAD2.b introduced by TALE nuclease pair BnFAD2_T02
cctctcctccctcaccctctcacttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 25451 - DNA, 384 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacgccgaggcgacacacgaagcgatcgttggcgtcggcaaacacatcgacgccaccattccaacaccggatccctcgagagggatgaagtgttcgtccccaagaagaaatcagacatcaagtggtacggcaagtacctcaacaaccctttgggacgcaccgtgatgttaacggttcagttcactctcggctggccgttgtacttag

SEQ ID NO: 25452 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25453 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25454 - DNA, 363 bp, Artificial
  Mutation in BnaC.FAD2.b introduced by TALE nuclease pair BnFAD2_T02
gctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctgtcctttgtacttag

SEQ ID NO: 25455 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatcgacgccaccattccaacactggctccctcgagagagacgaagtgtttgtccccaagaagaagtcagacatcaagtggtacggcaagtacctcaacaacccgctaggacgcaccgtgatgttaacggttcagttcactctcggctggcctttgtacttag

SEQ ID NO: 25456 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccttcatcgacgccaccattccaacaccggatccctcgagagggatgaagtgttcgtccccaagaagaaatccgacatcaagtggtacggaaagtacctcaacaacccgctaggacgcacggtggtgctaaccgtccagttcacgctgggctggcctttgtacttag

SEQ ID NO: 25457 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaccgggcctctgggtcatcgcccacgaatgcggccaccacgccttcagcgaccaccagtggctggacgacaccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25458 - DNA, 359 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcatttgtacttag

SEQ ID NO: 25459 - DNA, 352 bp, Artificial
  Mutation in BnaC.FAD2.b introduced by TALE nuclease pair BnFAD2_T02
cctctcctccctcaccctgtctcctacctcgcctggctcctcccccgggcctgccaaggctgcgtcccaccgggcccctgggtcatcgcccacgaatgtggccaccccgccttcagctaccaccaatcgctggacgacgccgtgtgcctcgtcttccactccttcctcctcgtcccttacttctcctggaatcgacgccaccattccaacaccggatccctcgagagggatgaagtgttcgtccccaagaagaaatccgacatcaagtggtacggagattagctcaacaaccgtcttggaggcacggtgaggcataccgtccaggtcacgctcccccgccctttgtacttag

SEQ ID NO: 25460 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccatcagtggctggacgacgccgtgggcctcgtcttccactccttcctcctcgtcccttacttctcctggaatcatcgacgccaccattccaacaccggatccctcgagagggatgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25461 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgcattcagcgaccatcagtgactggacgacgccgtgggcctcgtcttccactccttcctcctcgtcccttacttctcctggaatcatcgacgccaccattccaacaccggatccctcgagagggatgaagtgtttgtccccaagaagaagtcagacatcaagtggtacggcaagtacctcaacaacccgctaggtcgcacggtgatgctacccgtccagttcacgctcggctggcctttgtacttag

SEQ ID NO: 25462 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacaccggatccctcgagagggatgaagtgttcgtccccaagaagaaatccgacatcaagtggtacggaaattacctcaacaacccgctaggacgcacggtgaggctaaccgtccagtgcactctcggctggccgttgtacttag

SEQ ID NO: 25463 - DNA, 352 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25464 - DNA, 358 bp, Artificial
  Mutation in BnaC.FAD2.b introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25465 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 25466 - DNA, 324 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25467 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaattacagccatcgacgccaccattccaacaccggatccctcgagagggatgaagtgttcgtccccaagaagaaatccgacatcaagtggtacggaaagtacctcaacaacccgctaggacgcacgttgatgctaaccggccagttcacgctcggctggcctttgtacttag

SEQ ID NO: 25468 - DNA, 408 bp, Artificial
  Mutation in BnaC.FAD2.b introduced by TALE nuclease pair BnFAD2_T02
cctctcctccctcaccctcactcctacttcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttctccagcgcctgcttgccgccatcgtggctggcgatggccaccacctgagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctctgctggcctttgtacttag

SEQ ID NO: 25469 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctctgctggcctttgtacttag

SEQ ID NO: 25470 - DNA, 355 bp, Artificial
  Mutation in BnaC.FAD2.b introduced by TALE nuclease pair BnFAD2_T02
ccttcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25471 - DNA, 312 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25472 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagctaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 25473 - DNA, 394 bp, Artificial
  Mutation in BnaC.FAD2.b introduced by TALE nuclease pair BnFAD2_T02
cctctcctccctcaccctctctcctacttcgcctggcaactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtggtcgtccccaagaagaaatccgacatcaagtggtacggaaagtacctcaacaacccgctaggtcgcacggtgatgctaaccttccatttcacgctcggctggcctgtgcacttag

SEQ ID NO: 25474 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 25475 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 25476 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatcccccgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25477 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25478 - DNA, 360 bp, Artificial
  Mutation in BnaC.FAD2.b introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctactcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25479 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25480 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggccgttgtacttag

SEQ ID NO: 25481 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25482 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggcctcatcttccactccttcctcctcgtcccttacttctcctggagcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25483 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25484 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25485 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcttccatcgacgccaccattccaacaccggatccctcgagagggatgaagtgttcgtccccaagaagaaatctgacatcaagtggtacggaaagtacctcaacaacccgctaggacgcacggtgatgctaaccgtccagttcacgctcggctggcctttgtacttag

SEQ ID NO: 25486 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25487 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccatcgacgccaccattccaacaccgtatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25488 - DNA, 346 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacaccgtcggtctcatcttccactccttcctcctcgtcccgtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25489 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 25490 - DNA, 388 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggcagttccctactctcgcgttcgaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 25491 - DNA, 359 bp, Artificial
  Mutation in BnaC.FAD2.b introduced by TALE nuclease pair BnFAD2_T02
cctctcctccctcaccctctcccttacctcgcctggcccctctactgtgcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctagaagtagccatcgacgccaccattccaacaccggatccctcgagagagacgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25492 - DNA, 413 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggccatcgccagccactgactcgctgcgctcggtcgttcggctgcggcgagcggtgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 25493 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25494 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25495 - DNA, 356 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcacacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25496 - DNA, 358 bp, Artificial
  Mutation in BnaC.FAD2.b introduced by TALE nuclease pair BnFAD2_T02
cctctcctccctcaccctctcccttacctcgcctggcaactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25497 - DNA, 348 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttactcctcgtcccttacttcttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25498 - DNA, 402 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaagtcagacatcaagtggtacggcaagtacctcaacagccctttgggacgcaccgtgatgttaacggttcagttcacgctcggctggcctttgtacttag

SEQ ID NO: 25499 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccggccagttcacgctcggctggccgttgtacttag

SEQ ID NO: 25500 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttaattctcctggacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25501 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 25502 - DNA, 349 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcccatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 25503 - DNA, 356 bp, Artificial
  Mutation in BnaC.FAD2.b introduced by TALE nuclease pair BnFAD2_T02
catctcctccctcaccctctctcctacttcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25504 - DNA, 419 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatctccagcggctgttgccggtgctgtgccaggcccacggcttgacccctcagcaggtggtggcagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25505 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 25506 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtccctcacttctcctggaagtatacagtcatcgacgccaccattccaacactggctccctcgagagggatcaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25507 - DNA, 389 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25508 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25509 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactta

SEQ ID NO: 25510 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctcttggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25511 - DNA, 353 bp, Artificial
  Mutation in BnaC.FAD2.b introduced by TALE nuclease pair BnFAD2_T02
cctctcctccctcaccctctctcatacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25512 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccgacgtctgggtcatagcccacgagtgcggccaccacgccttcagcgactaccagtggctggacgacaccgtcggcctcatcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25513 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25514 - DNA, 378 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatatggcggcaagcaggcgctggagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25515 - DNA, 470 bp, Artificial
  Mutation in BnaC.FAD2.b introduced by TALE nuclease pair BnFAD2_T02
cctctcctccctcaccctctctcctacttcgcctcgcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtccagcgcctgcttgccaccgccattgctggcgatggccaccacctgctggggggtcacgccgtgggcctggcacggagggccttctgcttagtttgatgcccgccatttacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25516 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaatcatcgacgccaccattccaacactggctccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 25517 - DNA, 432 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagccaacgagtgcggccaccacgccttcagcgactaccagtggctggacgacaccgtcggtctcctcttccactccttcctcctcgtcccttacttctcctggaattgttgccggtgctgtgccaggcccacggcttgaccccggagcaggtggtggccatcgccagccacgatggcggcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25518 - DNA, 347 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaagtcagacatcaagcggtacggcaagtacctcaacaaccctttgggacgcaccgtgatgttaacggttcagttctctctcggctggcctttgtacttag

SEQ ID NO: 25519 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgccctttgtacttag

SEQ ID NO: 25520 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 25521 - DNA, 353 bp, Artificial
  Mutation in BnaC.FAD2.b introduced by TALE nuclease pair BnFAD2_T02
cctctcctccctcaccctctcacttacctcgcctggcccctctactcggcctgccaaggctgcgtcctcacgggcctctgggtcatcgcccacgaatgcggccaccccgccttcagcgaccaccagtgcctgcacgccgccgtgggcctcgtcttccactccttcctcctcgtcccttacttctcctggacatcgaccccaccattccaacaccggatccctcgagagggatgaagtgttcgtccccaagaagaaatccgacatcaagtggtacggaaagtacctcaacaacccgctaggacgcacggggaggctaaccgtccagttcacgctcggctggcctttgtacttag

SEQ ID NO: 25522 - DNA, 450 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagctgctggagacggtccagcggctgttgccggttctgtgccaggcccacggcttgaccccccagcaggtggtggccatcgccagcaataatgtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 25523 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcacgctcggctggcctttgtacttag

SEQ ID NO: 25524 - DNA, 355 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25525 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaagtcagacatcaagtggtacggcaagtacctcaacaaccctttgggacgcaccgtgatgttaacggttcagttctctctcggctggcctgtgtacttag

SEQ ID NO: 25526 - DNA, 473 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccacggcttgaccccggagcaggtggtggccatcgccagccacgatggcggcaagcaggcgctggagacggtccagcggctgttgccggtgctgtgccaggcccacggcttgaccccccagcaggtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25527 - DNA, 348 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggccgacgccgtgggcctcgtcttccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggccttagtacttag

SEQ ID NO: 25528 - DNA, 336 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgccatcgacgccaccattccaacaccggatccctcgagagggatgaagtgttcgtccccaagaagaaatccgacatcaagtggtccggaaagtacctcaacaacccgctaggacgcacggtgatgctaaccgtccagttcacgctcggctggcctttgtacttag

SEQ ID NO: 25529 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25530 - DNA, 355 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaatcatcgacgccaccattccaacactggctccctcgagagggatgaagtgttcgtccccaagaagaaatccgacatcaagtggtacggaaagtaccacaacaaccctgtggaacgcaccgtgattttaacgcttcagttcacgctcggctggcctttgtacttag

SEQ ID NO: 25531 - DNA, 391 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgtgcctcgtcttccactccttcctcctcgtcccttacttctcctggaagtacgatgttccagattacgctatcgatatcgccggccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25532 - DNA, 343 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttgccatcgacgccaccattccaacaccggatccctcgagagggatgaagtgttcgtccccaagaagaaatccgacatcaagtggtacggaaagtacctcaacaacccgctaggacgcacggtgatgctaaccggccatttcacgctcggctggcctgtgcacgtag

SEQ ID NO: 25533 - DNA, 346 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtaccgcaacaacccgctaggacgcacggtgatgctaaccggccatttcactctcggctggccgttgtacttag

SEQ ID NO: 25534 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25535 - DNA, 358 bp, Artificial
  Mutation in BnaC.FAD2.b introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtagctcaacaacccggtagggcgcacggggatgctaaccgtcccgttcacgctcggctggcctttgtacttag

SEQ ID NO: 25536 - DNA, 385 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctcttggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatccctcgggagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 25537 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25538 - DNA, 402 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcaagccgtgggcctggcacagcaccggcaacagccgctggaccgtctcctacagccatcgacgccaccattccaacaccggatccctcgtgagggatgaagtgttcgtccccaagaagaaatccgacatcaagtggtacggaaattacctcaacaaccccctaggacgcacggtgatgctaaccgtccagttcacgctcggctggcctgtgtacttag

SEQ ID NO: 25539 - DNA, 336 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 25540 - DNA, 358 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25541 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccggccagttcacgctcggctggccgttgtacttag

SEQ ID NO: 25542 - DNA, 359 bp, Artificial
  Mutation in BnaC.FAD2.b introduced by TALE nuclease pair BnFAD2_T02
cctctcctccctcaccctctcgcttacctcgcctggctcctccactgggcctgccaaggctgcgtcctaacgggcctctgggtcatcgcccacgaatgcggccaccccgacttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaattacctcagcgtcccgcgaggacgcgcggtggttcttaccgcccatgtcgcgctcccgtgccctttgcacttag

SEQ ID NO: 25543 - DNA, 326 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatccctcgagagggatgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 25544 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccattacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25545 - DNA, 352 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaatcgacgccaccattccaacaccggatccctcgagagggataaagtgttcgtccccaagaagaaacccgacatgaagtggtacggaaagtacctcagcaacccgctaggacgcacggtgattctaaccctccggttcacgctccgatggccttagtacttag

SEQ ID NO: 25546 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcgtcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25547 - DNA, 356 bp, Artificial
  Mutation in BnaC.FAD2.b introduced by TALE nuclease pair BnFAD2_T02
cctctcctccctcaccctctcccttacctcgcctggcctctctactgggcctgccaagggtgcgtcctaacgggcctctgggtcatcgcccacgaatgcggccaccacgccttcagctaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggcaagtacctcaacaaccctttgggacgcaccgtgatgttaaccgtccagttcacgctcggctggcctttgtacttag

SEQ ID NO: 25548 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25549 - DNA, 346 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25550 - DNA, 357 bp, Artificial
  Mutation in BnaC.FAD2.b introduced by TALE nuclease pair BnFAD2_T02
cctatcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaagtcagacatcaagtggtacgacaagtacctcaacaaccctgtgggacgcaccgtgatgttaacggttcagttcactctcggctggcctttgtactcag

SEQ ID NO: 25551 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtgtctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacatcccgctaggacgcacggtgatgctaaccgtccagttcacgctcggctggcctttgtacttag

SEQ ID NO: 25552 - DNA, 423 bp, Artificial
  Mutation in BnaC.FAD2.b introduced by TALE nuclease pair BnFAD2_T02
cctcacctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtagttaggccatcacttcaagaactctgtagcaccgcctacatacctcgctctgctaatcctgttagccatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggctggcctttgtacttag

SEQ ID NO: 25553 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctctgctggcctttgtacttag

SEQ ID NO: 25554 - DNA, 365 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtggctggacgacaccgtgggcctcgtcttccactccttcctcctcgtcccttacttcctcctcgtcccttacttctcatcgacaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25555 - DNA, 351 bp, Artificial
  Mutation in BnaC.FAD2.b introduced by TALE nuclease pair BnFAD2_T02
cctctcctccctcaccctctcccttacctcgcctggcccctctactgggcatgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggccgttgtacttag

SEQ ID NO: 25556 - DNA, 348 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacgccaccattccaacaccggatccctcgagagggatgaagttttcgtccccaagaagaaatccgacatcaagtggtacggaaagtacctcaacaacccgcaaggacgcacggtgatgctaaccgtccagttcacgctcggctggcctttgtacttag

SEQ ID NO: 25557 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctactggaatcgacgccaccattccaacaccggatccctcgagagggatgaagtgttcgtccccaagaagaaatccgacatcaagtggttcggaaagtacctcaacaacccgctaggacgcacggtgatgctaaccgtccagttcacgctcggcaggcctttgtacttag

SEQ ID NO: 25558 - DNA, 354 bp, Artificial
  Mutation in BnaC.FAD2.b introduced by TALE nuclease pair BnFAD2_T02
ccttcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagggatgaagtgttcgtccccaagaagaaatccgacatcaagtggtacggcaagtacctcaacaacccttggggacgcaccgtgatgttaacggttcagttcactctcggctggcctttgtacttag

SEQ ID NO: 25559 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 25560 - DNA, 345 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25561 - DNA, 345 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcttcccttacttcatcgacgccaccattccaacactggctccctcgagagagactaagtgtttgtccccaagaagaagtcagacatcaagtggtacggcaagtacctcaacaacccgctaggacgcatggggattctaaccggcccgtccacgctcggctggccgttgtacttag

SEQ ID NO: 25562 - DNA, 355 bp, Artificial
  Mutation in BnaC.FAD2.b introduced by TALE nuclease pair BnFAD2_T02
ctctcctccctcaccctctcccttacctcgcctgccccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacagcccgctaggacgcacggtgagtctaaccgtccagttctcgctcggctggccgttgtacttag

SEQ ID NO: 25563 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25564 - DNA, 379 bp, Artificial
  Mutation in BnaC.FAD2.b introduced by TALE nuclease pair BnFAD2_T02
cctctcctccctcaccctctcccttacctcgcctggcaactctactgggcctgccaaggctgcgtcctaacgggcctctgggtcatcgcccacgaatgcggccaccacgcattcagcgaccaccagtggctggacgacgccgtgggcctcgtcttccactccttccactccttacttactcgtcccctacaacctgcccatcggccaggccgacgccatcgacgccaccattccaacaccggatccctcgagagggatgaagtgttcgtccccaagaagaaatccgacatcaagtggtacggaaagtacctcaacaacccgctaggtcgcacggtgatgctaaccttccatttcacgctcggctggccggtgtacttag

SEQ ID NO: 25565 - DNA, 348 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25566 - DNA, 352 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25567 - DNA, 356 bp, Artificial
  Mutation in BnaC.FAD2.b introduced by TALE nuclease pair BnFAD2_T02
cctctcctccctcaccctctcccttacctcgcctggcccctccactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccggcatcaagtggtacggaaagtacctcaacatcccgctaggacgcacggtgatgctaaccgtccagttcacgctcggctggcctttgtacttag

SEQ ID NO: 25568 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcggcgaccaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25569 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggcgggcctttgtacttag

SEQ ID NO: 25570 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaacggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaaggacctcaacaacccgctaggacgcacggtgatgctaaccttccagttcacgcgccgctaccctttgtacttag

SEQ ID NO: 25571 - DNA, 401 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggcgctggagacggtccagctgctggtgccggtgctgtgccaatagtcattgacgccaccattccaacactggctccctcgagagagacgaagtgtttgtccccaagaagaagtcagacatcgagtggttcggcaagtacctcaacaacccgctaggacgcacggtgatgctaaccgtccagttcacgctcggctggcctttgtacttag

SEQ ID NO: 25572 - DNA, 355 bp, Artificial
  Mutation in BnaC.FAD2.b introduced by TALE nuclease pair BnFAD2_T02
cctctcctccctcccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25573 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactag

SEQ ID NO: 25574 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25575 - DNA, 391 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggaaagtacctcaacaacccgctaggacgcacggggatgctaaccttccagttcacgctcggctggcctttgtacttag

SEQ ID NO: 25576 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcgtcttccactccttcctcctcgtcccttacttctcctggagtcatcgacgccaccattccaacaccggatccctcgcgagggctgaagtgttcgtccccaagcagcactccgccatcacctcgttcggaaagtacctcaacaacccgctaggacgcacggtgatgctaaccgtccagttcacgctcggctggcctttgtacttag

SEQ ID NO: 25577 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25578 - DNA, 347 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgggggcggcccccacgccttcagcgaccaccaggggctggacgacgccgtgggcctcgtcttccactccttcctcctcgtcccttacttctcatcgacgccaccaatccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25579 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25580 - DNA, 358 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 25581 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaattacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 25582 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcatggtgatgctaaccgtccagttcacgctcggctggcctttgtacttag

SEQ ID NO: 25583 - DNA, 340 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcttccatcgacgccaccattccaacaccggatccctcgagagggatgaagtgttcgtccccaagaagaaatccgacatcaagtggtacggaaattacctcaacaacccgctaggacgcacggtgatgctaaccgtccagttcactctcggctggccgttgtacttag

SEQ ID NO: 25584 - DNA, 315 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25585 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 25586 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtccaaacgggcctctgggtcatcgcccacgaatgcggccaccaccccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25587 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25588 - DNA, 351 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaagccgacatcaagtggtacggaaagtaccccaacaacccgctaggacgcacggtgaggctaaccgtccagttcacgctcggctggcctttgtacttag

SEQ ID NO: 25589 - DNA, 357 bp, Artificial
  Mutation in BnaC.FAD2.b introduced by TALE nuclease pair BnFAD2_T02
cctctcctccctcaccctctcccttacctcgcctcgccccactactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaaccctctaggacgcacggtgatgctatccgtccagttctcgctcggctggcctttgtacttag

SEQ ID NO: 25590 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25591 - DNA, 358 bp, Artificial
  Mutation in BnaC.FAD2.b introduced by TALE nuclease pair BnFAD2_T02
cctctcctccctcaccctctcccttacctcgcctggcccatctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25592 - DNA, 427 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccgtcaggatggccttctgcttagtttgatgcctggcagtttatggcgggcgtcctgcccgccaccctccggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25593 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgcgcggccggcctttgtacttag

SEQ ID NO: 25594 - DNA, 358 bp, Artificial
  Mutation in BnaC.FAD2.b introduced by TALE nuclease pair BnFAD2_T02
cctctcctccctcaccctctcccttacctcgcctggcccatctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25595 - DNA, 356 bp, Artificial
  Mutation in BnaC.FAD2.b introduced by TALE nuclease pair BnFAD2_T02
cctctcctccctcaccctgtcccttacctcgcctggctcctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcaagagggatgaagtgttcgtccccaagaagaaatccgacatcaagtggtacggaaattacctcaacagccctttgggacgcaccgggaggttaacagttcagttcacgctcggctggcctttgtacttag

SEQ ID NO: 25596 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagagacgaagtgtttgtccccaagaagaagtcagacatcaagtggtacggcaagtacctcaacaaccctttgggacgcaccgtgatgttaacgggtcaggtcactctcggctggcctttgtacttag

SEQ ID NO: 25597 - DNA, 357 bp, Artificial
  Mutation in BnaC.FAD2.b introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggcttgacgacaccgtcggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25598 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttatccatgacgccaccattccaacaccggatccctcgatagggacgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 25599 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaaccatcgacgccaccattccaacaccggatccctcgggagggatgaagtgttcgtccccaagaagaaatccgacatcaagtggtacgaaaagtacctcaacaacccgctaggacgcacggtgatgctaaccgtcaagttcacgttcggctggcctttgtacttag

SEQ ID NO: 25600 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaatcatcgacgccaccattccaacaccggatccctcgagagggatgaagtgttcgtccccaagaagaaatccgacagcaagtggtacggaaagtacctcaacagcccgctaggacgcacggtgatgctaaccgtccagttcacgctcggctggcctttgtacttag

SEQ ID NO: 25601 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 25602 - DNA, 355 bp, Artificial
  Mutation in BnaC.FAD2.b introduced by TALE nuclease pair BnFAD2_T02
cctctcctccctcaccctctaccttacctcgcctggcacctctacagggcctgccaaggctgcgtcctaacgggcctctgggtcatcgcccacgaatgcggccaccacgccttcagcgaccaccagtggctggacgacgccgtgggcctcgtcttccactccttcctcctcgacccttacttctcctggagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggcaggcctttgtacttag

SEQ ID NO: 25603 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagtgaccaccagtggctgtacgacgccgtgggcctcgtcttccactccttcctcctcgtcccttacttctcctggaatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25604 - DNA, 404 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatctccagcgcctgcttgccaccgccattgctggcgatggccaccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25605 - DNA, 354 bp, Artificial
  Mutation in BnaC.FAD2.b introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactgactccctcgagagggatgaagtgttcgtccccaagaagaaatccgacatcaagtggtacggaaagtacctcaacaacccgctaggacgcacggtgatgctaaccgtccagttcacgcgcggctggcctgtgtacttag

SEQ ID NO: 25606 - DNA, 407 bp, Artificial
  Mutation in BnaC.FAD2.b introduced by TALE nuclease pair BnFAD2_T02
cctctcctccctcaccctctcccttacctcgtctggcctccctactcggcctgccagggctgcgccctaaccggcgtctgggtcatagcccacgagtgcggccaccacgccttcagcgactaccagtggctggacgacaccgtcggcctcatcttccactccttcctcctcgtcccttacttctcctggaagtacggtgctgttccgggcgatctcgatcagctcgatgtactcgtgggacagtcatcgacgccaccattccaacactggctccctcgagagggatgaattgttcgtccccaagaagaaatccgacatcaagtggtacgcaaattacctcaacaacccggtagggcgcacggggatgctacccgtccagttcccgctcggctggcctttgtacttag

SEQ ID NO: 25607 - DNA, 351 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcccggctggccttggtacttag

SEQ ID NO: 25608 - DNA, 353 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctctcagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25609 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtacacagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccgttgtacttag

SEQ ID NO: 25610 - DNA, 315 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccaattgcggtggcaagcaggcgctggagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25611 - DNA, 343 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttgccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcacgctcggctggcctttgtacttag

SEQ ID NO: 25612 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctgtgtacttag

SEQ ID NO: 25613 - DNA, 355 bp, Artificial
  Mutation in BnaC.FAD2.b introduced by TALE nuclease pair BnFAD2_T02
cctctcatccctcaccctctctcctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25614 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgctgccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaccaaccctctgggacgaccagtgactttaacggttcagttcacgctaggctggcatttgtacttag

SEQ ID NO: 25615 - DNA, 356 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25616 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtggctccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 25617 - DNA, 359 bp, Artificial
  Mutation in BnaC.FAD2.b introduced by TALE nuclease pair BnFAD2_T02
cctctcctccctcaccctctcccttacctcgtctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25618 - DNA, 356 bp, Artificial
  Mutation in BnaC.FAD2.b introduced by TALE nuclease pair BnFAD2_T02
cctctcctccctcaccctctcccttaccccttctggcccctttactgggcctcccaagggtgcgtcctaaccgccgtctgggtcatcgcccacgagtgcggccatcacgccttcagcgactaccagtggcttgacgacaccgtcgggctcatcttccactccttcctcctcgtcccttacttctcctggaagccatcgacgccaccattccaacacctgatccctcgtgagggatgaagtgttcgtccccaagaagaaatccgacatcgagtgatgcggaaagtccctcaacaccccgctaggtcgcaagggaatgctacccgtccagttcacgctcggctggcctttgtacttag

SEQ ID NO: 25619 - DNA, 362 bp, Artificial
  Mutation in BnaC.FAD2.b introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25620 - DNA, 353 bp, Artificial
  Mutation in BnaC.FAD2.b introduced by TALE nuclease pair BnFAD2_T02
cctctcctccctcaccctctcccttacctcgcctggcctctctactgggcctgtcagggctgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25621 - DNA, 355 bp, Artificial
  Mutation in BnaC.FAD2.b introduced by TALE nuclease pair BnFAD2_T02
cctctcctccctcaccctctctcctacttcgtctggcccctctactgggcctcccaacgctgcgccctaacggccctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaaatccgacatcaagtggtacggaaagtacctcaacgacccggtaggacgcacgggaaggctacccgtcccgttcacgctcggctggcctttgtacttag

SEQ ID NO: 25622 - DNA, 342 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccggataccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 25623 - DNA, 355 bp, Artificial
  Mutation in BnaC.FAD2.b introduced by TALE nuclease pair BnFAD2_T02
cctctcctccctcaccctctaccttacctcgcctggcccctttactgggcctcccaaggctgcgtcctaacgggcctctgggtcatcgcccacgaatgcggccaccacgccttcagcgaccaccagtggctggacgacgccgtggtcctcgtctgccactccttcctccacgtcccttacttctcctggagccatcgacgccaccattccaacaccggatccctcgagagggatgaagtggtcgtccccaagaagaaatccgacatcaagtggcacggaaggtacctcaccaacccgctaggacgcacggtgatgctacccgtccatgtcacgctcggctggcctttgtacttag

SEQ ID NO: 25624 - DNA, 354 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttgtacttag

SEQ ID NO: 25625 - DNA, 346 bp, Artificial
  Mutation in BnaC.FAD2.b introduced by TALE nuclease pair BnFAD2_T02
cctctcctccctcaccctctcgcttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25626 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25627 - DNA, 356 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25628 - DNA, 352 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcctcgcccacgaatgcggccaccacgccttcagcgaccaccagtggctggacgacgccgtgggcctcgtcttccactccttcctcctcgtcccttacttctgaagccatcgacgccaccattccaacaccggatccctcgagagggatgaagtgttcgtccccaagaagaaatccgacagcaagtggtacggaaattaccgcaacaaccggctaggacgcacggggattctaaccggccaggtcgctcgcggcgggcctttgtacttag

SEQ ID NO: 25629 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25630 - DNA, 358 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggccggcctgtgtacttag

SEQ ID NO: 25631 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 25632 - DNA, 357 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtaatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25633 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagggatgaagtgttcgtccccaagaagaaatccgacatcaagtggtacggaaagtacctcaacaacccgctaggccgcacggtgatgctaaccgtccagttcacgctcggctggcctttgtacttag

SEQ ID NO: 25634 - DNA, 360 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25635 - DNA, 411 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacagagcgaggtatgtaggcggtgctacagagttcttgaagtggtggcctacagccatcgacgccaccattccaacaccggatccctcgagagggatgaagtgttcgtccccaagaagaaatccgacatcaagtggtacggaaaggacctcaacaacccgctaggacgcacggtgatgctaaccgtccatgtcacgcgcggctggcctttgtacttag

SEQ ID NO: 25636 - DNA, 362 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcctctgggtcatagcccacgagtgcggccaccacgccttcagcgactaccagtggcttgacgacaccgtcggtctcatcttccactccttcctcctcgtcccttacttctcctggaagtcacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 25637 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactcgcggctggcctgtgtacttag

SEQ ID NO: 25638 - DNA, 358 bp, Artificial
  Mutation in BnaC.FAD2.b introduced by TALE nuclease pair BnFAD2_T02
cctctcctccctcaccctctcacttaactcgcctggcccctctcctgggcctgccaaggctgcgtcccaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacaccggatccctcgagagggatgaagtgttcgtccccaagaagaaatccgacatcaagtggtccggaaagtacctcaaccgcccgctaggacgcagggtgagtccaagagtccagttcactcgcggccgccctttgtacgtag

SEQ ID NO: 25639 - DNA, 362 bp, Artificial
  Mutation in BnaC.FAD2.b introduced by TALE nuclease pair BnFAD2_T02
cctctcctccctcaccctctcccttacctcgcctggcccctctcctggtcctgccacgtctgcgccctcccggccctctgggtcctcgcccccccattcgtcccccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacagcaagtggtacggaaagtacctcaacaacccgctaggacgcacggtgatgctaaccgtccagttcacgctcggctggcctttgtacttag

SEQ ID NO: 25640 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtaccgcaacaacccgctgggacgcacggtgatgctaaccgtccagtcctcgcgcggctggcctgtgtacttag

SEQ ID NO: 25641 - DNA, 336 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25642 - DNA, 273 bp, Artificial
  Mutation in BnaC.FAD2.b introduced by TALE nuclease pair BnFAD2_T02
cctctcctccctcaccctctctcctacttcgcctggaacctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcccggcgggcctgtgtacttag

SEQ ID NO: 25643 - DNA, 356 bp, Artificial
  Mutation in BnaC.FAD2.b introduced by TALE nuclease pair BnFAD2_T02
cctctcctccctcaccctctcccctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25644 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggtctcatcttccactccttcctcctcgtcccttacttctcctggacgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25645 - DNA, 357 bp, Artificial
  Mutation in BnaC.FAD2.b introduced by TALE nuclease pair BnFAD2_T02
cctctcctccctcaccctctcccttacctcgcctggcccatctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgtttgtccccaagaagaagtcagacatcaagtggtacggaaagtacctcaacaacccgctaggacgcacggtgatgctaaccgaccagttcacgctcggctggcctttgtacttag

SEQ ID NO: 25646 - DNA, 359 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggatgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 25647 - DNA, 350 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaaccggcgtctgggtcatagcccacgagtgcggccaccacgccttcagcgactaccagtggcttgacgacaccgtcggtctcctcttccactccttcctcctcgtcccttacttctcctcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25648 - DNA, 315 bp, Artificial
  Mutation in BnaC.FAD2.b introduced by TALE nuclease pair BnFAD2_T02
cctctcctccctcaccctctgtcctacttcgcctggcctctctcccgggcctgccaaggctgcgtcctaacgggcgtctgggtcatagcccacgagtgcggccaccacgccttcagcgaccaccaatggcggtggcaagcaggcgctggagccatcgacgccaccattccaacaccggatccctcgagagagacgaagtgtttgtccccaagaagaaatccgacatcaagtggtacggaaagtacctcaacaacccgctaggacgcacggtgaggctaaccgtccagttcacgctcggctggcctttgtacttag

SEQ ID NO: 25649 - DNA, 354 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctgtgtacttag

SEQ ID NO: 25650 - DNA, 353 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaacccgctaggacgcacggtgatgctatccgtccaggtcacgctcggctggcctttgtacgtag

SEQ ID NO: 25651 - DNA, 393 bp, Artificial
  Mutation in BnaC.FAD2.b introduced by TALE nuclease pair BnFAD2_T02
cctctcctccctcaccctctcccttacctcgcctggcacatctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatgttctttcctgcgttatcccctgattctgtggatatcgacgccaccattccaaccccggatccctcgagagggatgaagggttcgtccccaagaagaaatccgacatcaagtggtacggaaagtacctcaacaacccgctaggtcgcacggtgatgctaaccgtccagttcacgctcggccggcctgtgtacttag

SEQ ID NO: 25652 - DNA, 357 bp, Artificial
  Mutation in BnaC.FAD2.b introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgcctccattccaacactggctccctcgagagagacgaagtgttcgtccccaagaagaaatccgacatcaagtggtacggaaagtacctcaacaacccgctaggacgcacggtgatgctaaccggccaggtcacgctcgtctgtcctttgtacttag

SEQ ID NO: 25653 - DNA, 355 bp, Artificial
  Mutation in BnaC.FAD2.b introduced by TALE nuclease pair BnFAD2_T02
cctctcctccctcaccctctctcttacctcgcctggcccctctactgggcctgccaaggctgcgtcctaacgggcctctgggtcatcgcccacgaatgcggccaccacgccttcagcgaccaccagtggctagacgacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25654 - DNA, 356 bp, Artificial
  Mutation in BnaC.FAD2.b introduced by TALE nuclease pair BnFAD2_T02
cctctcctccctcaccctctcctacttcgcctggcctctctactgggcctgccaagggtgcgtcctaaacggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctgtgtacttag

SEQ ID NO: 25655 - DNA, 358 bp, Artificial
  Mutation in BnaC.FAD2.b introduced by TALE nuclease pair BnFAD2_T02
cctctcctccctcaccctctcccttacctcgcctggaccctctaatgggcctgccaaggatgcgtcctaacaggcctctgggtcatcgcccacgaatgcggccaccacgccttcagctaccaccagtggctggacgacgccgtgggcctcgtcttccactccttcctcctcgtcccttacttctcctggaagagccatcgacgccaccattccaacaccggatccctctagagggatgaagtgttcgtccccaagaagaaatccgacagcaagtggtccggaaagtacctcaacacccccctcggacgcaccgtgaggctatccgtccagttctcgctgggcggtcgtttgtacttag

SEQ ID NO: 25656 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggcctcatcttccactccttcctcatcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25657 - DNA, 331 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25658 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgctgccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25659 - DNA, 355 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 25660 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtctgcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25661 - DNA, 360 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 25662 - DNA, 347 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25663 - DNA, 360 bp, Artificial
  Mutation in BnaC.FAD2.b introduced by TALE nuclease pair BnFAD2_T02
cctctcctccctccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25664 - DNA, 356 bp, Artificial
  Mutation in BnaC.FAD2.b introduced by TALE nuclease pair BnFAD2_T02
cctctcctccctcaccctctctcctacttcgcctggcctctctcctgggcctgccaagggtgcgtcctaaccggcgtctgggttatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagtgattaagtgttcgtccccaagaagaaatccgacatcaagtggtacggaaagtacctcaacaaccctctaggacgcacggtgattctaaccgtccagttcacgctcggctggcctttgtacttag

SEQ ID NO: 25665 - DNA, 349 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgtcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25666 - DNA, 356 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 25667 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcatggtgatgctaaccgtccagttcacgctcggctggcctttgtacttag

SEQ ID NO: 25668 - DNA, 363 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacaccggatccctcgagagggatgaagtgttcgtccccaagaagaaatccgacatcaagtggtacggcaagtacctcaacagccctttgggacgcaccgtgatgttaacggttcaggtcactcgcggctggcctttgtacttag

SEQ ID NO: 25669 - DNA, 353 bp, Artificial
  Mutation in BnaC.FAD2.b introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25670 - DNA, 355 bp, Artificial
  Mutation in BnaC.FAD2.b introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25671 - DNA, 358 bp, Artificial
  Mutation in BnaC.FAD2.b introduced by TALE nuclease pair BnFAD2_T02
cctctcctccctcaccctctgacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtaatgctaaccgtccagttcacgcgcgggtggcctttgtacttag

SEQ ID NO: 25672 - DNA, 322 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctccaccattccaacaccggagccctcgagagggatgaagtgttcgtccccaagaagaaatccgacatcaagtggtacggaaagtgccgcaacagtccgctgggacgcacggtgaggctatggtgcgagttttggcgcggctggccggtgtacttag

SEQ ID NO: 25673 - DNA, 359 bp, Artificial
  Mutation in BnaC.FAD2.b introduced by TALE nuclease pair BnFAD2_T02
cctctcctccctcaccctctgccttacctcgcctggcccctctcttgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacaccggatccctcgagagggatgaagtgttcgtccccaagaagaaatccgacatcaagtggtacggaaagtacctcaacaaccggctaggacgcacgttgattctaaccttccagttcacgctcggctgtcctttgtgcttag

SEQ ID NO: 25674 - DNA, 357 bp, Artificial
  Mutation in BnaC.FAD2.b introduced by TALE nuclease pair BnFAD2_T02
cctctcctccctcaccctctaccttacctcgcctggcccctctacagggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaaggaccgcaacaacccgctaggacgcacggtgatgctaaccggccagttcacgcgcggctggcctttgtacttag

SEQ ID NO: 25675 - DNA, 358 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactag

SEQ ID NO: 25676 - DNA, 362 bp, Artificial
  Mutation in BnaC.FAD2.b introduced by TALE nuclease pair BnFAD2_T02
cctctcctccctcaccctctcccttacctcgcctggcacctctactgggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacaccggatccctcgagagggatgaagtgttcgtccccaataagaaatccggcatcaagtggtacggagagtacctcaacaacccgcttggacgcccggtgatgctaacctcccggttgaggcttgtctggcttttgtgcttag

SEQ ID NO: 25677 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcaggcctttgtacttag

SEQ ID NO: 25678 - DNA, 388 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtggcagttccctactctcgcgttcgaatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25679 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccagtccaacaccggatccctcgagagggatgaagtgttcgtccccaagaagaaatccgacagcaagtggtacggaaagtacctcaacaacccgctaggacgcacggtgatgctaaccgtccagttcacgctcggctggcctttgtacttag

SEQ ID NO: 25680 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccatagccatcgacgccaccattccaacaccggatccctcgagagggatgaagtgttcgtccccaagaagaaatccgacatcaagtggtacggaaattacctcaacaacccgctaggacgcacggtgatgctaaccgtccagttcacgctcggctggcctttgtacttag

SEQ ID NO: 25681 - DNA, 324 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcgcccggcctttgtacttag

SEQ ID NO: 25682 - DNA, 362 bp, Artificial
  Mutation in BnaC.FAD2.b introduced by TALE nuclease pair BnFAD2_T02
cctctcctccctcaccctctcacttacctcgcctggcccatctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 25683 - DNA, 340 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcttccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25684 - DNA, 356 bp, Artificial
  Mutation in BnaC.FAD2.b introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 25685 - DNA, 357 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggccggcctttgtacttag

SEQ ID NO: 25686 - DNA, 355 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactta

SEQ ID NO: 25687 - DNA, 355 bp, Artificial
  Mutation in BnaC.FAD2.b introduced by TALE nuclease pair BnFAD2_T02
cctctcctccctcaccctctcccttacctcgcctggaccatctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25688 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25689 - DNA, 350 bp, Artificial
  Mutation in BnaC.FAD2.b introduced by TALE nuclease pair BnFAD2_T02
cctctcctccctcaccctctcacttacctcgcctggcatctctcctgggcctgccaagggtgcgtcctaaccggcgtctgggtcatagcccacgagtgcggccaccacgacttcagcgactaccagtggcttgacgacaccgtcggtctcatcttccactccttcctcctcgtcccttacttctcctcatcgacgccaccattccaacaacggatccctcgagagggatgaagtgttcgtccccaagaagaaatccgacatcaactggtacggaaactacctcaacaacccgctagaacgcacggtgatgctaaccgtccatttcacgctcggccgccattagtacttag

SEQ ID NO: 25690 - DNA, 359 bp, Artificial
  Mutation in BnaC.FAD2.b introduced by TALE nuclease pair BnFAD2_T02
cctctcctccctcaccctctaccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcgcggtgattctatccgtccagttcacgctcggctggcctttgtacttag

SEQ ID NO: 25691 - DNA, 354 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 25692 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacacccctttgggacgcaccgtgatgttaacggttcagttcactctcggctggcctttgtccttag

SEQ ID NO: 25693 - DNA, 273 bp, Artificial
  Mutation in BnaC.FAD2.b introduced by TALE nuclease pair BnFAD2_T02
cctctcctccctcaccctctctcctacttcgcctggcttctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25694 - DNA, 356 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25695 - DNA, 349 bp, Artificial
  Mutation in BnaC.FAD2.b introduced by TALE nuclease pair BnFAD2_T02
cctctcctccctcaccctctcccttacctcgcctggcccccctcctgggcctgccaaggctgcgtcctaacgggcctctgggccttcgcccccgaatgcggccaccccgccttcagcgaccaccagtggctggacgacgccgtgggcctcgtcttccactccttcctcctcgtcccttacttctcctgtcgacgccaccattccaacaccggatccctcgagagggatgaagtgttcgtccccaagaagaaatccgacatcaagtggtacggaaagtacctcaacaaccagctaggacgcacggtgatgctaaccgtccagttcacgctcggctggcctttgtacttag

SEQ ID NO: 25696 - DNA, 362 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccgctagaacgcacggtgatgctaaccgtccagttcacgctcggctggcctttgtacttag

SEQ ID NO: 25697 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgcgcggctggcctgtgtacttag

SEQ ID NO: 25698 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaaccgtgtgggacgcaccgggatgttaacggttcagttcactctcggctggcctttgtacttag

SEQ ID NO: 25699 - DNA, 362 bp, Artificial
  Mutation in BnaC.FAD2.b introduced by TALE nuclease pair BnFAD2_T02
cctctcctccctcaccctctcccttacctcgcctggcccctctcctgggcctgcccaggctgcgtcccaacgggcctctgggtcatcgcccacgaatgcggccaccacgccttcagccaccaccagtcgctggtcgacgccgcgggcctcgtcttccactccttcctcctcggcccttacttctcctggaagttacagccatcgacgccaccattccaacaccggatccctcgagagggatgaagtgttcgtccccaagaagaaatcccacatcaagtggtacggaaagttcctcagcaagcggctgggacgcaggctgaggctaagcgtccaggtcaggcgcggctggcctttgtacttag

SEQ ID NO: 25700 - DNA, 344 bp, Artificial
  Mutation in BnaC.FAD2.b introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25701 - DNA, 409 bp, Artificial
  Mutation in BnaC.FAD2.b introduced by TALE nuclease pair BnFAD2_T02
cctctcctccctcaccctctctcctacttcgcctggcctccctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtgcgctctcctgttccgaccctgccgcttaccggatacctgtccgcctttctgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctgtgtacttag

SEQ ID NO: 25702 - DNA, 356 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 25703 - DNA, 357 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggaaagtacctcaacaacccgctaggacgcacggtgaggctaaccgaccagttcacgctcggccggcctttgtacttag

SEQ ID NO: 25704 - DNA, 358 bp, Artificial
  Mutation in BnaC.FAD2.b introduced by TALE nuclease pair BnFAD2_T02
cctctcctccctcaccctctctcctacttcgcctggcctctctcccgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggaaagtacctcaacagccggctaggacgcacggtgagtctaagcgtccagttcaggctcggctggcctctgtacttag

SEQ ID NO: 25705 - DNA, 363 bp, Artificial
  Mutation in BnaC.FAD2.b introduced by TALE nuclease pair BnFAD2_T02
cctctcctccctcaccctctctcctacttcgcctggcctctctactgggcctgccaagtgtgcgtcctaacgggcctctgggtcatcgcccacgagtgcggccaccacgccttcagcgactaccagtggcttgacgacaccgtcggtctcatcttccactccttcctcctcgtcccttacttctcctggaagttatcagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 25706 - DNA, 355 bp, Artificial
  Mutation in BnaC.FAD2.b introduced by TALE nuclease pair BnFAD2_T02
cctctcctccctcaccctctcccttacctcgcctggcccctctactggtcctgccaaggctgcgtcctaacgggcctctgggtcatcgcccacgaatgcggccaccacgccttcagcgaccaccagtggccaggcgacgccgtggtcctcgtcttccactccttcctcctcttcccttacttctcctggaaccatcgacgccaccattccaacacccgatccctcgagagagatgaagggttcgtccccaagaagaaatccaacatcaagtggtaccgaaagtacctcaacaacccgctaggaagcacggtgatgctaacctgcaagttcacgcgcggctggcctttgtacgtag

SEQ ID NO: 25707 - DNA, 357 bp, Artificial
  Mutation in BnaC.FAD2.b introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggacccctcgagagggatgaagtgttcgtccccaagaagaaatccgacatcaagtggtacggaaagtacctcaacaacccgctaggacgcacggtgatgctaaccgtccagttcacgctcggctggcctttgtacttag
